(12) United States Patent
Facchini et al.

(10) Patent No.: US 10,793,885 B2
(45) Date of Patent: Oct. 6, 2020

(54) COMPOSITIONS AND METHODS FOR MAKING NOSCAPINE AND SYNTHESIS INTERMEDIATES THEREOF

(71) Applicant: Willow BioSciences Inc., Calgary (CA)

(72) Inventors: Peter James Facchini, Calgary (CA); Xue Chen, Calgary (CA); Thi Thu Thuy Dang, Calgary (CA)

(73) Assignee: Willow BioSciences Inc., Calgary, Alberta (CA)

(*) Notice: Subject to any disclaimer, the term of this patent is extended or adjusted under 35 U.S.C. 154(b) by 0 days.

(21) Appl. No.: 14/912,263

(22) PCT Filed: Aug. 15, 2014

(86) PCT No.: PCT/CA2014/050782
§ 371 (c)(1),
(2) Date: Feb. 16, 2016

(87) PCT Pub. No.: WO2015/021561
PCT Pub. Date: Feb. 19, 2015

(65) Prior Publication Data
US 2016/0201101 A1 Jul. 14, 2016

Related U.S. Application Data

(60) Provisional application No. 61/866,733, filed on Aug. 16, 2013, provisional application No. 62/008,877, filed on Jun. 6, 2014.

(51) Int. Cl.
*C12P 17/18* (2006.01)
*C07D 491/056* (2006.01)

(52) U.S. Cl.
CPC .......... *C12P 17/18* (2013.01); *C07D 491/056* (2013.01)

(58) Field of Classification Search
None
See application file for complete search history.

(56) References Cited

FOREIGN PATENT DOCUMENTS

| CA | 2728766 A1 | 12/2009 |
|----|-----------|---------|
| WO | 2013136057 A2 | 9/2013 |

OTHER PUBLICATIONS

Julien, B et al. Isolation and Characterization of the epothilone biosynthetic gene cluster from Sorangium cellulosm. 2000. Gene. 249. p. 153-160. (Year: 2000).*
Dang, T. et al., "CYP82Y1 is N-Methylcanadine 1-Hydroxylase, a Key Noscapine Biosynthetic Enzyme in Opium Poppy", J. Bio. Chem., vol. 289, No. 4, p. 2013-2026, Dec. 2013.
Sariyar, G. et al., "Six Alkaloids from Papaver Species", Phytochemistry, vol. 25, No. 10, p. 2403-2406, 1986.
Winzer, T. et al., "A Papaver somniferum 10-Gene Cluster for Synthesis of the Anticancer Alkaloid Noscapine", Science, vol. 336, No. 6089, p. 1704-E708, May 31, 2012.

* cited by examiner

*Primary Examiner* — Paul J Holland
(74) *Attorney, Agent, or Firm* — Bereskin & Parr LLP/S.E.N.C.R.L., s.r.l.; Micheline Gravelle

(57) ABSTRACT

Methods for the manufacture of the therapeutic chemical compound noscapine and noscapine synthesis intermediates comprising contacting a noscapine pathway precursor selected from a first canadine derivative, a first papaveroxine derivative and narcotine hemiacetal with at least one of the enzymes selected from the group CYP82Y1, CYP82X1, AT1, CYP82X2, OMT, CXE1 and NOS.

14 Claims, 23 Drawing Sheets
Specification includes a Sequence Listing.

m/z 386

| C-number | δ ($^{13}$C) | δ ($^1$H) | INT | m | J | COSY | HSQC (H→C) | HSQC (m) / RING ID | HMBC (H→C) |
|---|---|---|---|---|---|---|---|---|---|
| 5 | 24.13 | 2.95 | 1.00 | dd | 17.1, 6.2 | 3.16, 3.42 | 24.13 | CH$_2$ (A) | 92.4 (vw), 119.1 (w), 117.3 (vw) |
| 5 | 24.13 | 3.15 | 1.00 | m | - | 3.42, 2.95 | 24.13 | CH$_2$ (A) | 51.1, 53.6, 92.4 (w), 117.3 (w) |
| 6 | 53.55 | 3.14 | 1.00 | m | - | 3.42, 2.95 | 53.55 | CH$_2$ (B) | 24.1, 70.3 (w) |
| NCH$_3$ | 51.08 | 3.26 | 3.00 | s | - | - | 51.08 | CH$_3$ (A) | 53.6, 61.0, 70.3, 118.8 (w) |
| 6 | 53.55 | 3.42 | 1.00 | td | 13.2, 11.6, 6.3 | 3.16, 2.95 | 53.55 | CH$_2$ (B) | 51.1, 24.1 |
| OCH$_3$ (9) | 61.15 | 3.87 | 3.00 | s | - | - | 61.15 | CH$_3$ (B) | 144.9 |
| OCH$_3$ (10) | 56.07 | 3.89 | 3.00 | s | - | - | 56.07 | CH$_3$ (C) | 152.1 |
| 8 | 60.99 | 4.73 | 1.00 | d | 15.10 | 4.82 | 60.99 | CH$_2$ (C) | 53.6, 118.8, 70.3 (w), 51.1 (w), 127.4 (w), 144.9 (w), 152.1 (vw) |
| 8 | 60.99 | 4.82 | 1.00 | d | 15.10 | 4.73 | 60.99 | CH$_2$ (C) | 70.3, 118.8, 117.1 (vw), 127.4, 144.9, 53.6 (w), 51.1 (w) |
| 13 | 73.82 | 4.92 | 1.00 | d | 6.50 | 5.02, 4.73 (w) | 73.82 | | 70.3, 117.3, 118.8, 124.5, 127.3 |
| 14 | 70.27 | 5.02 | 1.00 | d | 5.80 | 4.92, 3.16 (w) | 5.02 | | 51.1 (vw), 73.8, 117.3, 119.1, 53.6, 152.7 (w) |
| exo | 99.78 | 5.80 | 1.00 | d | 1.50 | 5.84 | 99.78 | CH$_2$ (D) | 148.5, 135.1 |
| exo | 99.78 | 5.84 | 1.00 | d | 1.50 | 5.80 | 99.78 | CH$_2$ (D) | 148.5, 135.1 |
| 4 | 92.38 | 5.85 | 1.00 | s | - | - | 92.38 | | 24.1, 117.3, 135.1 |
| 11 | 114.11 | 7.03 | 1.00 | d | 8.50 | 7.26, 4.73 (w), 3.89 (w) | 114.11 | A | 152.1 (w), 127.4, 144.9 |
| 12 | 124.91 | 7.26 | 1.00 | d | 8.50 | 7.03, 4.92 (w), 4.82 (w) | 124.91 | A | 152.1, 118.8, 73.8 |
| 14α | 117.26 | Q | - | - | - | - | - | B | - |
| 8α | 118.79 | Q | - | - | - | - | - | A | - |
| 4α | 119.14 | Q | - | - | - | - | - | B | - |
| 12α | 127.4 | Q | - | - | - | - | - | A | - |
| 2 | 135.06 | Q | - | - | - | - | - | B | - |
| 9 | 144.87 | Q | - | - | - | - | - | A | - |
| 3 | 148.48 | Q | - | - | - | - | - | B | - |
| 10 | 152.11 | Q | - | - | - | - | - | A | - |
| 14 | 152.69 | Q | - | - | - | - | - | B | - | m/z 428

| C-number | δ ($^{13}$C) | δ ($^1$H) | INT | m | J | COSY | HSQC (H→C) | HSQC (m) / RING ID | HMBC (H→C) |
|---|---|---|---|---|---|---|---|---|---|
| 5 | 23.5 | 3.09 | 1.00 | m | - | 3.15, 3.30 (w), 3.50 | 23.5 | CH$_2$ (A) | 113.0 (vw), 122.2 (w), |
| 5 | 23.5 | 3.15 | 1.00 | m | - | 3.09, 3.30, 3.50 | 23.5 | CH$_2$ (A) | 53.2 (vw), 113.0 (vw), 122.2 (w) |
| 6 | 53.2 | 3.30 | 1.00 | m | - | 3.09 (w), 3.15, 3.50 | 53.2 | CH$_2$ (B) | 122.2 (vw) |
| NCH$_3$ | 51.8 | 3.37 | 3.00 | s | - | - | 51.8 | CH$_3$ (A) | 53.2, 60.6, 64.8, 120.8 (w) |
| 6 | 53.2 | 3.50 | * | m | - | 3.09, 3.15, 3.30 | 53.2 | CH$_2$ (B) | - |
| OCH$_3$ (9) | 61.2 | 3.90 | 3.00 | s | - | - | 61.2 | CH$_3$ (B) | 145.6 |
| OCH$_3$ (10) | 56.1 | 3.89 | 3.00 | s | - | - | 56.1 | CH$_3$ (C) | 153.3 |
| 8 | 60.6 | 4.92 | 1.00 | d | 15.30 | 4.96 | 60.6 | CH$_2$ (C) | 51.8, 64.8, 120.8, 122.8, 145.6 (w) |
| 8 | 60.6 | 4.96 | 1.00 | d | 15.30 | 4.92 | 60.60 | CH$_2$ (C) | 51.8, 120.8, 122.8, 145.6 (w) |
| 13 | 71.4 | 6.10 | 1.00 | d | 6.80 | 5.60 | 71.4 | CH | 64.8, 113.0, 120.8, 122.8, 124.6 (w), 170.2 |
| 14 | 64.8 | 5.59 | 1.00 | d | 6.80 | 6.10 | 64.8 | CH | 53.2, 71.4, 113.0, 122.2, 139.2 (w) |
| exo | 102 | 5.97 | 2.00 | s | - | - | ** | ** | 135.5, 149.9 |
| 4 | 101.5 | 6.32 | 1.00 | s | - | - | 101.5 | CH | 23.5, 113.0, 135.5, 139.2 (vw), 149.9 (w) |
| 11 | 113.9 | 7.01 | 1.00 | d | 8.60 | 7.03 | 113.9 | CH | 122.8, 145.6 |
| 12 | 124.6 | 7.03 | 1.00 | d | 8.60 | 7.01 | 124.6 | CH (A) | 71.4 (w), 120.8, 153.3 |
| 14α | 113 | Q | - | - | - | - | - | - | - |
| 8α | 120.8 | Q | - | - | - | - | - | - | - |
| 4α | 122.2 | Q | - | - | - | - | - | - | - |
| 12α | 122.8 | Q | - | - | - | - | - | - | - |
| 2 | 135.5 | Q | - | - | - | - | - | - | - |
| 1 | 139.2 | Q | - | - | - | - | - | - | - |
| 9 | 145.6 | Q | - | - | - | - | - | - | - |
| 3 | 149.9 | Q | - | - | - | - | - | - | - |
| 10 | 153.3 | Q | - | - | - | - | - | - | - |
| CH$_3$(CO) | 20.9 | 2.10 | 3.00 | s | - | - | 20.90 | CH3 | 71.4 (vw), 170.2 |
| C(O) | 170.2 | Q | - | - | - | - | - | - | - |

\* peak overlap inhibits accurate integration
\*\* crosspeak not apparent in HSQC spectrum; assignment made using HMBC (breakthrough of coupled CH crosspeaks)

FIG. 15

4'-desmethoxy-papaveroxine

Narcotoline hemiacetal

Narcotoline

COMPOSITIONS AND METHODS FOR MAKING NOSCAPINE AND SYNTHESIS INTERMEDIATES THEREOF

RELATED APPLICATION

This application is a national phase entry application of Patent Cooperation Treaty Application No. PCT/CA2014/050782 (which designates the U.S.), which claims the benefit under 35 USC § 119(e) from U.S. Provisional Patent Application No. 61/866,733, filed on Aug. 16, 2013 and U.S. Provisional Patent Application No. 62/008,877, filed on Jun. 6, 2014, both all of which are incorporated herein by reference in their entirety.

INCORPORATION OF SEQUENCE LISTING

A computer readable form of the Sequence Listing "21806-P44664US02_SequenceListing.txt" (1,667,072 bytes), submitted via EFS-WEB and amended on Apr. 22, 2016, is herein incorporated by reference.

FIELD OF THE DISCLOSURE

The compositions and methods disclosed herein relate to secondary metabolites and processes for manufacturing the same. More particularly, the present disclosure relates to noscapine and synthesis intermediates thereof and methods for manufacturing noscapine and synthesis intermediates.

BACKGROUND OF THE DISCLOSURE

The following paragraphs are provided by way of background to the present disclosure. They are not however an admission that anything discussed therein is prior art or part of the knowledge of persons skilled in the art.

The biochemical pathways of living organisms are commonly classified as being either part of primary metabolism or part of secondary metabolism. Pathways that are part of a living cell's primary metabolism are involved in catabolism for energy production or in anabolism for building block production for the cell. Secondary metabolites, on the other hand, are produced by living cells without having any obvious anabolic or catabolic function. It has however long been recognized that many secondary metabolites are useful in many respects, including for example as therapeutic agents. The secondary metabolite noscapine is produced by opium poppy (*Papaver somniferum*) and other members of the Papaveraceae family of plants and may be used as a pharmaceutical agent, including in the treatment of cancer and as a cough suppressant (see: Mahmoudian et al., 2009, Recent patents on Anti-Cancer Drug Discovery 4 (1): 92-97).

The secondary metabolite pathway through which noscapine is produced in *Papaver somniferum* heretofore has not been disclosed. However it is noted that the prior art speculates that several enzymes are involved in the synthesis of noscapine in opium poppy. Notably Winzer et. al. (Winzer et al. Science, 2012, 336: 1704-1708) discloses ten genes which the authors believe to be involved in noscapine biosynthesis in opium poppy. It is unclear however how these genes are involved in noscapine biosynthesis and, moreover, whether and how these genes may be used in the commercial manufacture of noscapine.

Currently noscapine and certain noscapine synthesis intermediates may be harvested from natural sources, such as opium poppy. Alternatively these compounds may be prepared synthetically. The existing manufacturing methods for noscapine however suffer from low yields of noscapine and/or are expensive. No methods exist to biosynthetically make noscapine. There exists therefore in the art a need for improved methods for the synthesis of noscapine and noscapine synthesis intermediates.

SUMMARY OF THE DISCLOSURE

The following paragraphs are intended to introduce the reader to the more detailed description that follows and not to define or limit the claimed subject matter of the present disclosure.

The present disclosure relates to the secondary metabolite noscapine and synthesis intermediates of noscapine, as well as to methods of making noscapine and synthesis intermediates thereof. The current disclosure further relates to certain enzymes capable of catalyzing reactions resulting in the conversion of noscapine synthesis intermediates to form noscapine.

Accordingly, the present disclosure provides in at least one aspect at least one embodiment of making noscapine or a noscapine synthesis intermediate comprising:

(a) providing a noscapine pathway precursor selected from a first canadine derivative, a first papaveroxine derivative and narcotine hemiacetal; and (b) contacting the noscapine pathway precursor with at least one of the enzymes selected from the group of enzymes consisting of (i) CYP82Y1; (ii) CYP82X2; (iii) AT1; (iv) CYP82X1; (v) OMT; (vi) CXE1; and (vii) NOS under reaction conditions permitting the catalysis of the noscapine pathway precursor to form noscapine or the noscapine synthesis intermediate, wherein the noscapine synthesis intermediate is a second canadine derivative, a first or second papaveroxine derivative, narcotine hemiacetal or noscapine;

and wherein the first canadine derivative has the chemical formula (I):

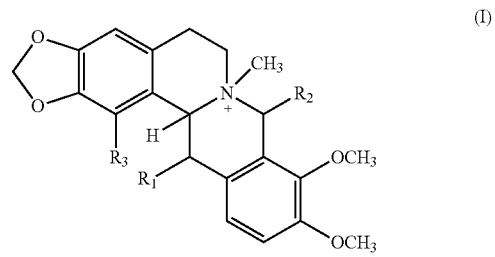

wherein $R_1$ represents a hydrogen atom, hydroxyl or O-acetyl;

wherein $R_2$ represents a hydrogen atom or hydroxyl; and wherein $R_3$ represents a hydrogen atom or hydroxyl;

wherein the second canadine derivative has the chemical formula (II):

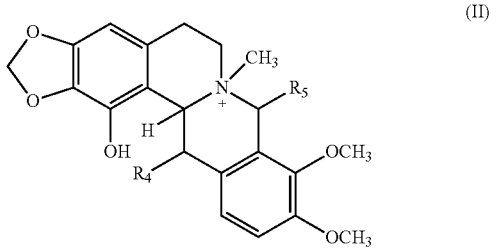

(II)

wherein R$_4$ represents a hydrogen atom, hydroxyl; or O-acetyl; and wherein R$_5$ represents a hydrogen atom or hydroxyl; and wherein the first and second papaveroxine derivative have the chemical formula (III):

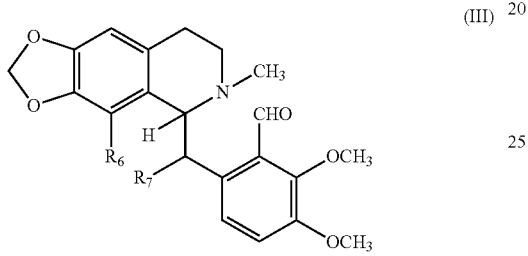

(III)

wherein R$_6$ represents hydroxyl or methoxy; and
wherein R$_7$ represents hydroxyl or O-acetyl.

In preferred embodiments of the disclosure, the first canadine derivative is (S)—N-methylcanadine; 1-hydroxy-N-methylcanadine; 1,13-dihydroxy-N-methylcanadine, 1-hydroxy-13-O-acetyl-N-methylcanadine; or 1,8-dihydroxy-13-O-acetyl-N-methylcanadine; the second canadine derivative is 1-hydroxy-N-methylcanadine; 1,13-dihydroxy-N-methylcanadine, 1-hydroxy-13-O-acetyl-N-methylcanadine; or 1,8-dihydroxy-13-O-acetyl-N-methylcanadine; and the first and second papaveroxine derivatives are 4'-O-desmethoxy-3-O-acetyl-papaveroxine; papaveroxine; or 3-O-acetyl-papaveroxine.

In a further aspect, the present disclosure provides at least one embodiment of making noscapine and each of the following noscapine synthesis intermediates: 1-hydroxy-N-methylcanadine; 1,13-dihydroxy-N-methylcanadine; 1-hydroxy-O-acetyl-N-methylcanadine; 1,8-dihydroxy-13-O-acetyl-N-methylcanadine; 4'-O-desmethoxy-3-O-acetyl-papaveroxine; 3-O-acetyl-papaveroxine; papaveroxine; and narcotine hemiacetal. Accordingly, the present disclosure further provides in at least one aspect:

(I) at least one embodiment of making noscapine comprising:
  (a) providing (a) (S)—N-methylcanadine; and
  (b) contacting (S)—N-methylcanadine with a mixture comprising catalytic quantities of the enzymes (i) CYP82Y1; (ii) CYP82X2; (iii) AT1; (iv) CYP82X1; (v) OMT; (vi) CXE1; and (vii) NOS under reaction conditions permitting an enzyme catalyzed chemical conversion of (S)—N-methylcanadine to noscapine.

(II) at least one embodiment of making narcotine hemiacetal comprising:
  (a) providing (a) (S)—N-methylcanadine; and
  (b) contacting (S)—N-methylcanadine with a mixture comprising catalytic quantities of the enzymes (a) CYP82Y1; (b) CYP82X2; (c) AT1; (d) CYP82X1; (e) OMT and (f) CXE1 under reaction conditions permitting an enzyme catalyze chemical conversion of (S)—N-methylcanadine to narcotine hemiacetal.

(III) at least one embodiment of making papaveroxine comprising:
  (a) providing (a) (S)—N-methylcanadine; and
  (b) contacting (S)—N-methylcanadine with a mixture comprising catalytic quantities of the enzymes (a) CYP82Y1; (b) CYP82X2; (c) AT1; (d) CYP82X1; (e) OMT and (0 CXE1 under reaction conditions permitting an enzyme catalyzed chemical conversion of (S)—N-methylcanadine to papaveroxine; and (IV) at least one embodiment of making 3-O-acetyl-papaveroxine comprising:
  (a) providing (a) (S)—N-methylcanadine; and
  (b) contacting (S)—N-methylcanadine with a mixture comprising catalytic quantities of the enzymes (a) CYP82Y1; (b) CYP82X2; (c) AT1; (d) CYP82X1 and (e) OMT under reaction conditions permitting an enzyme catalyzed chemical conversion of (S)—N-methylcanadine to 3-O-acetyl-papaveroxine;

(V) at least one embodiment of making 4'-O-desmethoxy-3-O-acetyl-papaveroxine comprising:
  (a) providing (a) (S)—N-methylcanadine; and
  (b) contacting (S)—N-methylcanadine with a mixture comprising catalytic quantities of the enzymes (a) CYP82Y1; (b) CYP82X2; (c) AT1 and (d) CYP82X1 under reaction conditions permitting an enzyme catalyzed chemical conversion of (S)—N-methylcanadine to 4'-O-desmethoxy-3-O-acetyl-papaveroxine;

(VI) at least one embodiment of making 1,8-dihydroxy-13-O-acetyl-N-methylcanadine comprising:
  (a) providing (a) (S)—N-methylcanadine; and
  (b) contacting (S)—N-methylcanadine with a mixture comprising catalytic quantities of the enzymes (a) CYP82Y1; (b) CYP82X2; (c) AT1 and (d) CYP82X1 under reaction conditions permitting an enzyme catalyzed chemical conversion of (S)—N-methylcanadine to 1,8-dihydroxy-13-O-acetyl-N-methylcanadine;

(VII) at least one embodiment of making 1-hydroxy-13-O-acetyl-N-methylcanadine comprising:
  (a) providing (a) (S)—N-methylcanadine; and
  (b) contacting (S)—N-methylcanadine with a mixture comprising catalytic quantities of the enzymes (a) CYP82Y1; (b) CYP82X2 and (c) AT1 under reaction conditions permitting an enzyme catalyzed chemical conversion of (S)—N-methylcanadine to 1-hydroxy-13-O-acetyl-N-methylcanadine;

(VIII) at least one embodiment of making 1,13-dihydroxy-N-methylcanadine comprising:
  (a) providing (a) (S)—N-methylcanadine; and
  (b) contacting (S)—N-methylcanadine with a mixture comprising catalytic quantities of the enzymes (a) CYP82Y1 and (b) CYP82X2 under reaction conditions permitting an enzyme catalyzed conversion of (S)—N-methylcanadine to 1,13-dihydroxy-N-methylcanadine; and (IX) at least one embodiment of making 1-hydroxy-N-methylcanadine comprising:
  (a) providing (a) (S)—N-methylcanadine; and
  (b) contacting (S)—N-methylcanadine with a mixture comprising catalytic quantities of the enzyme CYP82Y1 under reaction conditions permitting an enzyme catalyzed chemical conversion of (S)—N-methylcanadine to 1-hydroxy-N-methylcanadine;

In a further aspect, the present disclosure relates to compounds that may be derivatized from noscapine synthesis intermediates, and methods of making such derivatized compounds. Thus, in a further aspect, the present disclosure provides, in at least one embodiment, methods of preparing certain derivatives of noscapine synthesis intermediates, including narcotoline hemiacetal and narcotinoline.

In yet a further aspect, the present disclosure provides, in at least one embodiment, the aforementioned embodiments wherein the mixtures comprising catalytic quantities of enzyme(s) and the noscapine synthesis intermediate are brought together under in vitro reaction conditions. In another embodiment, the mixtures comprising catalytic quantities of enzymes and the noscapine synthesis intermediate are brought together under in vivo reaction conditions.

The present disclosure further provides in substantially pure form the following noscapine synthesis intermediates: 1-hydroxy-N-methylcanadine; 1,13-dihydroxy-N-methylcanadine; 1-hydroxy-O-acetyl-N-methylcanadine; and 4'-O-desmethoxy-3-O-acetyl-papaveroxine.

Other features and advantages of the present disclosure will become apparent from the following detailed description. It should be understood, however, that the detailed description, while indicating preferred implementations of the disclosure, are given by way of illustration only, since various changes and modifications within the spirit and scope of the disclosure will become apparent to those of skill in the art from the detailed description

BRIEF DESCRIPTION OF THE DRAWINGS

The disclosure is in the hereinafter provided paragraphs described in relation to its Figures. The Figures provided herein are provided for illustration purposes and are not intended to limit the present disclosure.

(FIG. 13A); (B) Absence of products when either CYP82X1 (CPR/82X1) or CYP82X2 (CPR/82X2) was incubated with (S)-1,13-dihydroxy-N-methylcanadine (m/z 386) (FIG. 13 B); (C) The activity of native recombinant AT1 on (S)-1,13-dihydroxy-N-methylcanadine (m/z 386), forming (S)-1-hydroxy-13-O-acetyl-N-methylcanadine (m/z 428). (FIG. 13 C); (D) The activity of CYP82X1 (CPR/82X1) converting (S)-1-hydroxy-13-O-acetyl-N-methylcanadine (m/z 428) to (S)-1,8-dihydroxy-13-O-acetyl-N-methylcanadine, which spontaneously rearranges to form 4'-O-desmethyl-3-O-acetylpapaveroxine (m/z 444). (FIG. 13D); (E) cleavage of the O-acetyl moiety from 3-O-acetylpapaveroxine (m/z 458) by native recombinant CXE1 yielding papaveroxine, which spontaneously rearranges to form narcotine hemiacetal (m/z 416). (FIG. 13 E).

FIG. 15 shows certain NMR data relating to the enzymatic activity of AT1. Shown are the enzymatic substrate (S)-1, 13-dihydroxy-N-methylcanadine (m/z 386) and the reaction product (S)-1-hydroxy-13-O-acetyl-N-methylcanadine (m/z 428) are shown.

DETAILED DESCRIPTION OF THE DISCLOSURE

Figure 1:
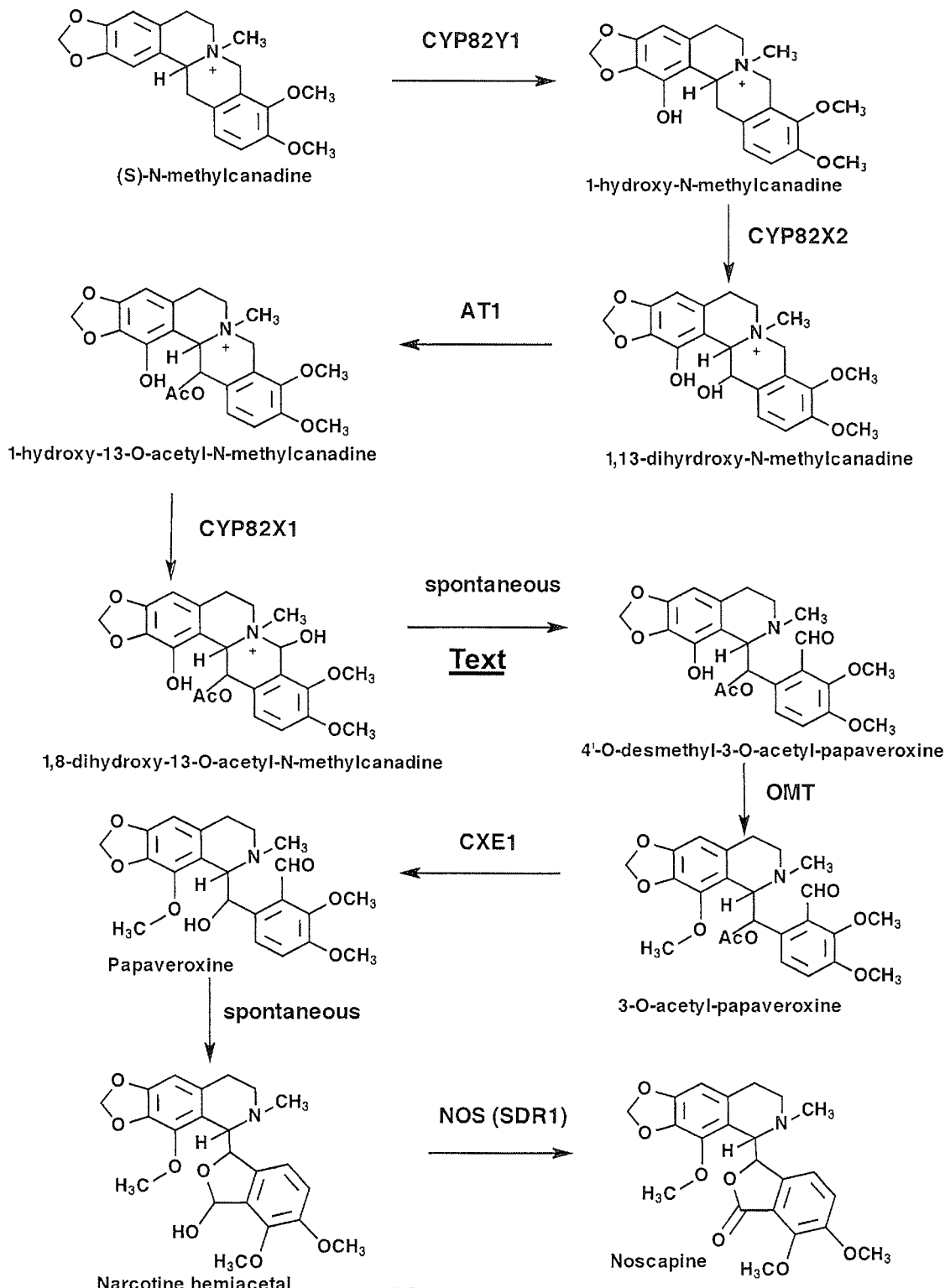
FIG. 1 depicts a synthesis pathway for the manufacture of noscapine and synthesis intermediates thereof. Included are the chemical structures of the synthesis intermediates and enzymes capable of catalyzing chemical conversion of the synthesis intermediates.

Various compositions and processes will be described below to provide an example of an embodiment of each claimed subject matter. No embodiment described below limits any claimed subject matter and any claimed subject matter may cover processes, compositions or systems that differ from those described below. The claimed subject matter is not limited to compositions or processes having all of the features of any one composition, system or process described below or to features common to multiple or all of the compositions, systems or processes described below. It is possible that a composition, system or process described below is not an embodiment of any claimed subject matter. Any subject matter disclosed in a composition, system or process described below that is not claimed in this document may be the subject matter of another protective instrument, for example, a continuing patent application, and the applicants, inventors or owners do not intend to abandon, disclaim or dedicate to the public any such subject matter by its disclosure in this document.

It should be noted that terms of degree such as "substantially", "about" and "approximately" as used herein mean a reasonable amount of deviation of the modified term such that the end result is not significantly changed. These terms of degree should be construed as including a deviation of the modified term if this deviation would not negate the meaning of the term it modifies.

As used herein, the wording "and/or" is intended to represent an inclusive-or. That is, "X and/or Y" is intended to mean X or Y or both, for example. As a further example, "X, Y, and/or Z" is intended to mean X or Y or Z or any combination thereof.

All publications, patents and patent applications are herein incorporated by reference in their entirety to the same extent as if each individual publication, patent or patent application was specifically and individually indicated to be incorporated by reference in its entirety.

As hereinbefore mentioned, the present disclosure relates to the secondary metabolite noscapine and synthesis intermediates of noscapine, as well as to methods of making noscapine and synthesis intermediates thereof. The current disclosure further relates to certain enzymes capable of catalyzing reactions resulting in the conversion of noscapine synthesis intermediates to form noscapine. The herein provided methods represent a novel and efficient means of manufacturing noscapine and noscapine synthesis intermediates. The methods provided herein do not rely on chemical synthesis and may be conducted at commercial scale. To the best of the inventors' knowledge, the current disclosure provides for the first time a methodology to manufacture noscapine using living cells not normally capable of synthesizing noscapine. Such cells may be used as a source whence noscapine may economically be extracted. Noscapine produced in accordance with the present disclosure is useful inter alia in the manufacture of pharmaceutical compositions for the treatment of cancer. Furthermore the present disclosure provides various heretofore unknown noscapine synthesis intermediates. These synthesis intermediates are useful in the manufacture of noscapine, as well as noscapine derivatives.

Accordingly, the present disclosure provides in at least one aspect at least one embodiment of making noscapine or a noscapine synthesis intermediate comprising:

(a) providing a noscapine pathway precursor selected from a first canadine derivative, a first papaveroxine derivative and narcotine hemiacetal; and (b) contacting the noscapine pathway precursor with at least one of the enzymes selected from the group of enzymes consisting of (i) CYP82Y1; (ii) CYP82X2; (iii) AT1; (iv) CYP82X1; (v) OMT; (vi) CXE1; and (vii) NOS under reaction conditions permitting the catalysis of the noscapine pathway precursor to form noscapine or the noscapine synthesis intermediate wherein the noscapine synthesis intermediate is a second canadine derivative, a first or second papaveroxine derivative, narcotine hemiacetal or noscapine;

and wherein the first canadine derivative has the chemical formula (I):

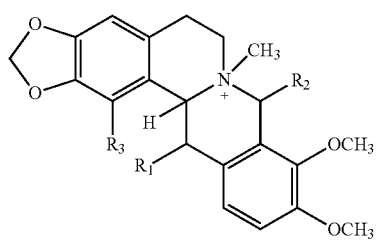

(I)

wherein $R_1$ represents a hydrogen atom, hydroxyl, or O-acetyl;

wherein $R_2$ represents a hydrogen atom or hydroxyl; and wherein $R_3$ represents a hydrogen atom or hydroxyl;

wherein the second canadine derivative has the chemical formula (II):

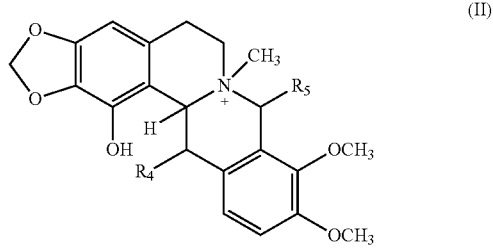

(II)

wherein $R_4$ represents a hydrogen atom, hydroxyl; or O-acetyl; and wherein $R_5$ represents a hydrogen atom or hydroxyl; and wherein the first and second papaveroxine derivative have the chemical formula (III):

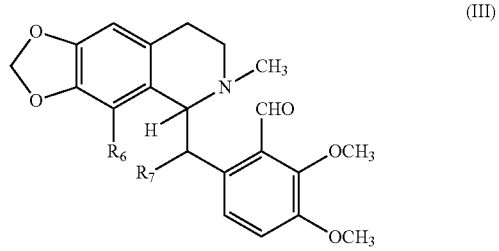

(III)

wherein $R_6$ represents hydroxyl or methoxy; and wherein $R_7$ represents hydroxyl or O-acetyl.

In preferred embodiments of the disclosure the first canadine derivative is (S)—N-methylcanadine; 1-hydroxy-N-methylcanadine; 1,13-dihydroxy-N-methylcanadine, 1-hydroxy-13-O-acetyl-N-methylcanadine; or 1,8-dihydroxy-13-O-acetyl-N-methylcanadine; the second canadine derivative is 1-hydroxy-N-methylcanadine; 1,13-dihydroxy-N-methylcanadine, 1-hydroxy-13-O-acetyl-N-methylcanadine; or 1,8-dihydroxy-13-O-acetyl-N-methylcanadine; and the first and second papaveroxine derivatives are 4'-O-desmethoxy-3-O-acetyl-papaveroxine; papaveroxine; or 3-O-acetyl-papaveroxine.

Definitions

Figure 2:
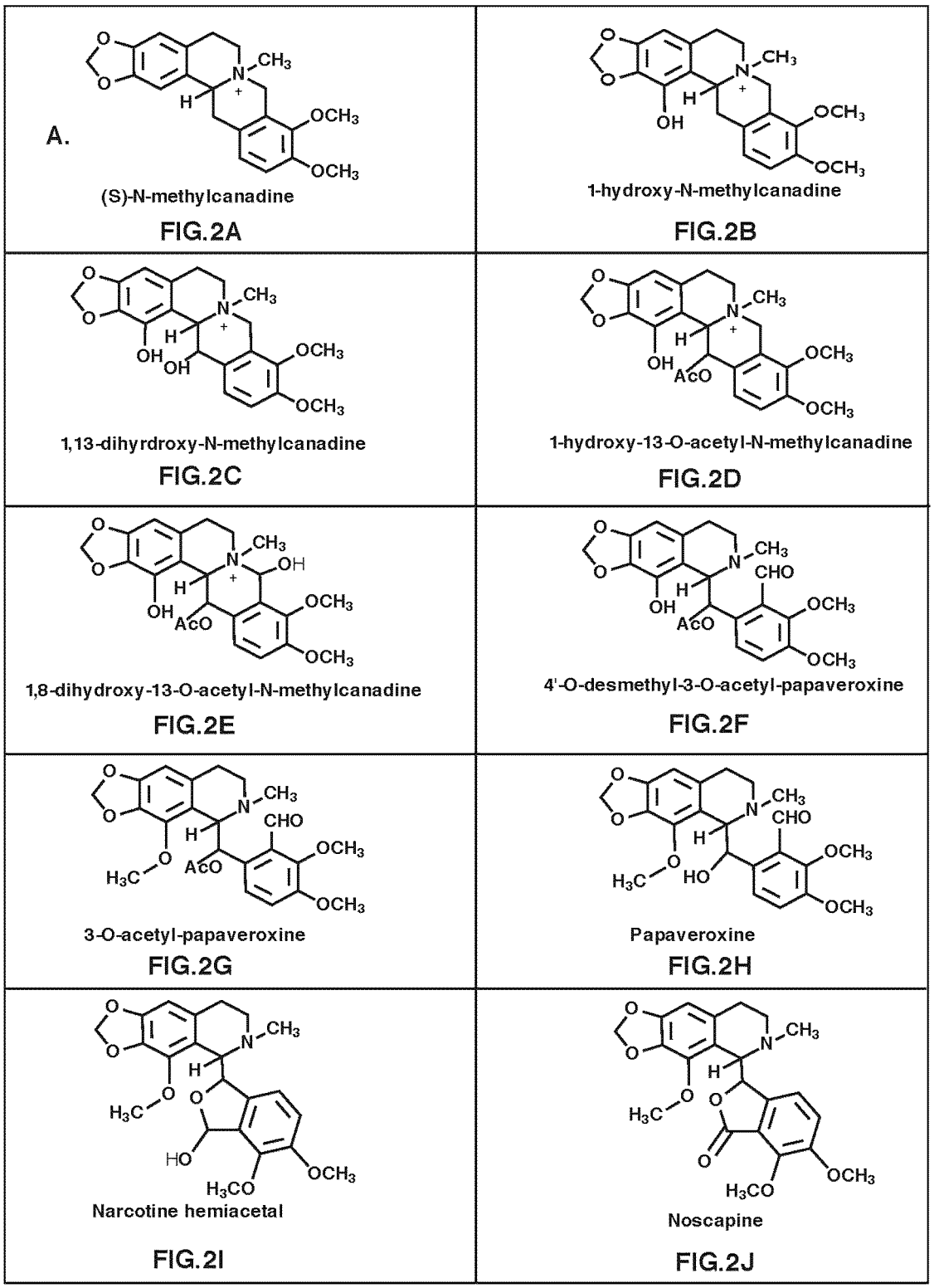
FIG. 2 depicts the chemical structures for noscapine (FIG. 2.J) and the following synthesis intermediates thereof: (S)—N-methylcanadine (FIG. 2A); 1-hydroxy-N-methylcanadine (FIG. 2B); 1,13-dihydroxy-N-methylcanadine (FIG. 2C); 1-hydroxy-O-acetyl-N-methylcanadine (FIG. 2D); 1,8-dihydroxy-13-O-acetyl-N-methylcanadine (FIG. 2E); 4'-O-desmethoxy-3-O-acetyl-papaveroxine (FIG. 2F); 3-O-acetyl-papaveroxine (FIG. 2G); papaveroxine (FIG. 2H); and narcotine hemiacetal (FIG. 2I), respectively.

The term "noscapine" as used herein refers to a chemical compound having the chemical structure depicted in FIG. 2J.

The term "(S)—N-methylcanadine" as used herein refers to a chemical compound having the chemical structure depicted in FIG. 2A.

The term "1-hydroxy-N-methylcanadine" as used herein refers to a chemical compound having the chemical structure depicted in FIG. 2B.

The term "1,13-dihydroxy-N-methylcanadine" as used herein refers to a chemical compound having the chemical structure depicted in FIG. 2C.

The term "1-hydroxy-13-O-acetyl-N-methylcanadine" as used herein refers to a chemical compound having the chemical structure depicted in FIG. 2D.

The term "1,8-dihydroxy-13-O-acetyl-N-methylcanadine" as used herein refers to a chemical compound having the chemical structure depicted in FIG. 2E.

The terms "4'-O-desmethoxy-3-O-acetyl-papaveroxine" and "4'-O-desmethyl-3-O-acetylpapaveroxine", as may be used herein interchangeably, refer to a chemical compound having the chemical structure depicted in FIG. 2F.

The term "3-O-acetyl-papaveroxine" as used herein refers to a chemical compound having the chemical structure depicted in FIG. 2G.

The term "papaveroxine" as used herein refers to a chemical compound having the chemical structure depicted in FIG. 2H.

The term "narcotine hemiacetal" as used herein refers to a chemical compound having the chemical structure depicted in FIG. 2I.

Figure 23A:
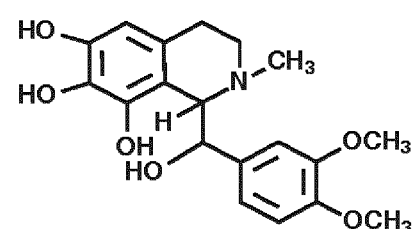
FIG. 23 depicts the chemical structures for 4'-desmethoxy-papaveroxine (FIG. 23A), narcotoline hemiacetal (FIG. 23B) and narcotoline (FIG. 23C).

The terms "4'-desmethoxypapaveroxine" and "4'-desmethylpapaveroxine", as may be used herein interchangeably, refer to a chemical compound having the chemical structure depicted in FIG. 23A.

Figure 23B:
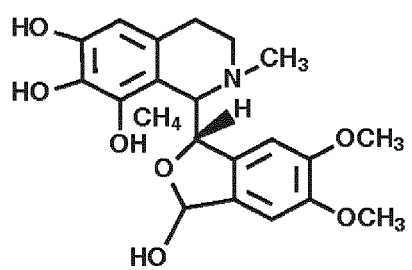

The term "narcotoline hemiacetal" as used herein refers to a chemical compound having the chemical structure depicted in FIG. 23B.

Figure 23C:
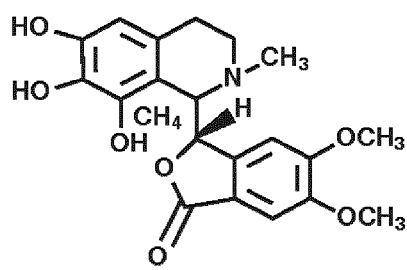

The term "narcotoline" as used herein refers to a chemical compound having the chemical structure depicted in FIG. 23C.

The term "papaveroxine derivative" as used herein includes any specified derivative compounds of papaveroxine, and may further include papaveroxine, as the context permits.

The terms "noscapine pathway" or "noscapine synthesis pathway", as may be used interchangeably herein, refer to the metabolic pathway for the synthesis of noscapine depicted in FIG. 1. When a first chemical compound within the noscapine pathway is referenced as "upstream" of a second chemical compound in the pathway, it is meant herein that synthesis of the first chemical compound precedes synthesis of the second chemical compound. Conversely, when a first chemical compound is referenced as "downstream" from a second chemical compound in the noscapine pathway, it is meant herein that synthesis of the second chemical compound precedes synthesis of the first chemical compound.

The term "noscapine pathway precursor" as used herein refers to any of the chemical compounds in the noscapine synthesis pathway set forth in FIG. 2A; FIG. 2B; FIG. 2C; FIG. 2D; FIG. 2E; FIG. 2F; FIG. 2G; FIG. 2H and FIG. 2I; in conjunction with the term noscapine synthesis intermediate, noscapine pathway precursor refers to a compound synthesized upstream of a noscapine synthesis intermediate.

The term "noscapine synthesis intermediate" as used herein refers to any of the chemical compounds in the noscapine synthesis pathway set forth in FIG. 2B; FIG. 2C; FIG. 2D; FIG. 2E; FIG. 2F; FIG. 2G; FIG. 2H and FIG. 2I; in conjunction with the term noscapine pathway precursor, noscapine synthesis intermediate refers to a compound synthesized downstream of a noscapine pathway precursor.

The term "noscapine synthesis intermediate derivative" as used herein refers to any chemical compound that may be derivatized from a noscapine synthesis intermediate or noscapine pathway precursor, including, without limitation, 4'-desmethoxy-papaveroxine, narcotoline hemiacetal and narcotoline, but excluding any of the compounds set forth in FIG. 2A-FIG. 2I.

The term "CYP82Y1" refers to any and all enzymes comprising a sequence of amino acid residues which is (i) substantially identical to the amino acid sequences constituting any CYP82Y1 polypeptide set fort herein, including, for example, SEQ.ID NO:2, or (ii) encoded by a nucleic acid sequence capable of hybridizing under at least moderately stringent conditions to any nucleic acid sequence encoding any CYP82Y1 polypeptide set forth herein, but for the use of synonymous codons.

The term "CYP82X2" refers to any and all enzymes comprising a sequence of amino acid residues which is (i) substantially identical to the amino acid sequences constituting any CYP82X2 polypeptide set forth herein, including, for example, SEQ.ID NO:4, or (ii) encoded by a nucleic acid sequence capable of hybridizing under at least moderately stringent conditions to any nucleic acid sequence encoding any CYP82X2 polypeptide set forth herein, but for the use of synonymous codons.

The term "AT1" refers to any and all enzymes comprising a sequence of amino acid residues which is (i) substantially identical to the amino acid sequences constituting any AT1 polypeptide set forth herein, including, for example, SEQ.ID NO:6, or (ii) encoded by a nucleic acid sequence capable of hybridizing under at least moderately stringent conditions to any nucleic acid sequence encoding any AT1 polypeptide set forth herein, but for the use of synonymous codons.

The term "CYP82X1" refers to any and all enzymes comprising a sequence of amino acid residues which is (i) substantially identical to the amino acid sequences constituting any CYP82X1 polypeptide set fort herein, including, for example, SEQ.ID NO:8, or (ii) encoded by a nucleic acid sequence capable of hybridizing under at least moderately stringent conditions to any nucleic acid sequence encoding any CYP82X1 polypeptide set forth herein, but for the use of synonymous codons.

The term "OMT" refers to any and all enzymes comprising a sequence of amino acid residues which is (i) substantially identical to the amino acid sequences constituting any OMT polypeptide set forth herein, including, for example, SEQ.ID NO:10, or (ii) encoded by a nucleic acid sequence capable of hybridizing under at least moderately stringent conditions to any nucleic acid sequence encoding any OMT polypeptide set forth herein, but for the use of synonymous codons.

The term "CXE1" refers to any and all enzymes comprising a sequence of amino acid residues which is (i) substantially identical to the amino acid sequences constituting any CXE1 polypeptide set forth herein, including, for example, SEQ.ID NO:12, or (ii) encoded by a nucleic acid sequence capable of hybridizing under at least moderately stringent conditions to any nucleic acid sequence encoding any CXE1 polypeptide set forth herein, but for the use of synonymous codons. Included within the definition of CXE1 is further specifically an enzyme having an amino acid sequence substantially identical to SEQ.ID NO:12, referred to as CXE2 for which the sequence is set forth in SEQ.ID NO:16.

The terms "NOS" or "SDR1", which may be used interchangeably herein, refer to any and all enzymes comprising a sequence of amino acid residues which is (i) substantially identical to the amino acid sequences constituting any NOS or SDR1 polypeptide set forth herein, including, for example, SEQ.ID NO:14, or (ii) encoded by a nucleic acid sequence capable of hybridizing under at least moderately stringent conditions to any nucleic acid sequence encoding any NOS or SDR1 polypeptide set forth herein, but for the use of synonymous codons.

The term "nucleic acid sequence" as used herein refers to a sequence of nucleoside or nucleotide monomers consisting of naturally occurring bases, sugars and intersugar (backbone) linkages. The term also includes modified or substituted sequences comprising non-naturally occurring monomers or portions thereof. The nucleic acid sequences of the present disclosure may be deoxyribonucleic acid sequences (DNA) or ribonucleic acid sequences (RNA) and may include naturally occurring bases including adenine, guanine, cytosine, thymidine and uracil. The sequences may also contain modified bases. Examples of such modified bases include aza and deaza adenine, guanine, cytosine, thymidine and uracil, and xanthine and hypoxanthine.

The herein interchangeably used terms "nucleic acid sequence encoding CYP82Y1" and "nucleic acid sequence encoding a CYP82Y1 polypeptide", refer to any and all nucleic acid sequences encoding a CYP82Y1 polypeptide, including, for example, SEQ.ID NO:1. Nucleic acid sequences encoding a CYP82Y1 polypeptide further include any and all nucleic acid sequences which (i) encode polypeptides that are substantially identical to the CYP82Y1 polypeptide sequences set forth herein; or (ii) hybridize to any CYP82Y1 nucleic acid sequences set forth herein under at least moderately stringent hybridization conditions or which would hybridize thereto under at least moderately stringent conditions but for the use of synonymous codons.

The herein interchangeably used terms "nucleic acid sequence encoding CYP82X2" and "nucleic acid sequence encoding a CYP82X2 polypeptide", refer to any and all nucleic acid sequences encoding a CYP82X2 polypeptide, including, for example, SEQ.ID NO:3. Nucleic acid sequences encoding a CYP82X2 polypeptide further include any and all nucleic acid sequences which (i) encode polypeptides that are substantially identical to the CYP82X2 polypeptide sequences set forth herein; or (ii) hybridize to any CYP82X2 nucleic acid sequences set forth herein under at least moderately stringent hybridization conditions or which would hybridize thereto under at least moderately stringent conditions but for the use of synonymous codons.

The herein interchangeably used terms "nucleic acid sequence encoding AT1" and "nucleic acid sequence encoding an AT1 polypeptide", refer to any and all nucleic acid sequences encoding an AT1 polypeptide, including, for example, SEQ.ID NO:5. Nucleic acid sequences encoding an AT1 polypeptide further include any and all nucleic acid sequences which (i) encode polypeptides that are substantially identical to the AT1 polypeptide sequences set forth herein; or (ii) hybridize to any AT1 nucleic acid sequences set forth herein under at least moderately stringent hybridization conditions or which would hybridize thereto under at least moderately stringent conditions but for the use of synonymous codons.

The herein interchangeably used terms "nucleic acid sequence encoding CYP82X1" and "nucleic acid sequence encoding a CYP82X1 polypeptide", refer to any and all nucleic acid sequences encoding a CYP82X1 polypeptide, including, for example, SEQ.ID NO:7. Nucleic acid sequences encoding a CYP82X1 polypeptide further include any and all nucleic acid sequences which (i) encode polypeptides that are substantially identical to the CYP82X1 polypeptide sequences set forth herein; or (ii) hybridize to any CYP82X1 nucleic acid sequences set forth herein under at least moderately stringent hybridization conditions or which would hybridize thereto under at least moderately stringent conditions but for the use of synonymous codons.

The herein interchangeably used terms "nucleic acid sequence encoding OMT" and "nucleic acid sequence encoding a OMT polypeptide", refer to any and all nucleic acid sequences encoding a OMT polypeptide, including, for example, SEQ.ID NO:9. Nucleic acid sequences encoding a OMT polypeptide further include any and all nucleic acid sequences which (i) encode polypeptides that are substantially identical to the OMT polypeptide sequences set forth herein; or (ii) hybridize to any OMT nucleic acid sequences set forth herein under at least moderately stringent hybridization conditions or which would hybridize thereto under at least moderately stringent conditions but for the use of synonymous codons.

The herein interchangeably used terms "nucleic acid sequence encoding CXE1" and "nucleic acid sequence encoding a CXE1 polypeptide", refer to any and all nucleic acid sequences encoding a CXE1 polypeptide, including, for example, SEQ.ID NO:11. Nucleic acid sequences encoding a CXE1 polypeptide further include any and all nucleic acid sequences which (i) encode polypeptides that are substantially identical to the CXE1 polypeptide sequences set forth herein; or (ii) hybridize to any CXE1 nucleic acid sequences set forth herein under at least moderately stringent hybridization conditions or which would hybridize thereto under at least moderately stringent conditions but for the use of synonymous codons. Included within the definition of nucleic acid sequence encoding CXE1 is further specifically a nucleic acid sequence substantially identical to SEQ.ID NO:11, referred to as a nucleic acid sequence encoding CXE2 for which the sequence is set forth in SEQ.ID NO: 15.

The herein interchangeably used terms "nucleic acid sequence encoding NOS", "nucleic acid sequence encoding a NOS polypeptide", "nucleic acid sequence encoding SDR1", "nucleic acid sequence encoding an SDR1 polypeptide", refer to any and all nucleic acid sequences encoding an NOS or SDR1 polypeptide, including, for example, SEQ.ID NO:13. Nucleic acid sequences encoding a NOS or SDR1 polypeptide further include any and all nucleic acid sequences which (i) encode polypeptides that are substantially identical to the NOS or SDR1 polypeptide sequences set forth herein; or (ii) hybridize to any NOS or SDR1 nucleic acid sequences set forth herein under at least moderately stringent hybridization conditions or which would hybridize thereto under at least moderately stringent conditions but for the use of synonymous codons.

By the term "substantially identical" it is meant that two polypeptide sequences preferably are at least 70% identical, and more preferably are at least 85% identical and most preferably at least 95% identical, for example 96%, 97%, 98% or 99% identical. In order to determine the percentage of identity between two polypeptide sequences the amino acid sequences of such two sequences are aligned, using for example the alignment method of Needleman and Wunsch (J. Mol. Biol., 1970, 48: 443), as revised by Smith and Waterman (Adv. Appl. Math., 1981, 2: 482) so that the highest order match is obtained between the two sequences and the number of identical amino acids is determined between the two sequences. Methods to calculate the percentage identity between two amino acid sequences are generally art recognized and include, for example, those described by Carillo and Lipton (SIAM J. Applied Math., 1988, 48:1073) and those described in Computational Molecular Biology, Lesk, e.d. Oxford University Press, New York, 1988, Biocomputing: Informatics and Genomics Projects. Generally, computer programs will be employed for such calculations. Computer programs that may be used in this regard include, but are not limited to, GCG (Devereux et al., Nucleic Acids Res., 1984, 12: 387) BLASTP, BLASTN and FASTA (Altschul et al., J. Molec. Biol., 1990:215:403). A particularly preferred method for determining the percentage identity between two polypeptides involves the Clustal W algorithm (Thompson, J D, Higgines, D G and Gibson T J, 1994, Nucleic Acid Res 22(22): 4673-4680 together with the BLOSUM 62 scoring matrix (Henikoff S & Henikoff, J G, 1992, Proc. Natl. Acad. Sci.

USA 89: 10915-10919 using a gap opening penalty of 10 and a gap extension penalty of 0.1, so that the highest order match obtained between two sequences wherein at least 50% of the total length of one of the two sequences is involved in the alignment.

By "at least moderately stringent hybridization conditions" it is meant that conditions are selected which promote selective hybridization between two complementary nucleic acid molecules in solution. Hybridization may occur to all or a portion of a nucleic acid sequence molecule. The hybridizing portion is typically at least 15 (e.g. 20, 25, 30, 40 or 50) nucleotides in length. Those skilled in the art will recognize that the stability of a nucleic acid duplex, or hybrids, is determined by the Tm, which in sodium containing buffers is a function of the sodium ion concentration and temperature (Tm=81.5° C.−16.6 (Log 10 [Na+])+0.41(% (G+C)−600/l), or similar equation). Accordingly, the parameters in the wash conditions that determine hybrid stability are sodium ion concentration and temperature. In order to identify molecules that are similar, but not identical, to a known nucleic acid molecule a 1% mismatch may be assumed to result in about a 1° C. decrease in Tm, for example if nucleic acid molecules are sought that have a >95% identity, the final wash temperature will be reduced by about 5° C. Based on these considerations those skilled in the art will be able to readily select appropriate hybridization conditions. In preferred embodiments, stringent hybridization conditions are selected. By way of example the following conditions may be employed to achieve stringent hybridization: hybridization at 5× sodium chloride/sodium citrate (SSC)/5×Denhardt's solution/1.0% SDS at Tm (based on the above equation) −5° C., followed by a wash of 0.2×SSC/0.1% SDS at 60° C. Moderately stringent hybridization conditions include a washing step in 3×SSC at 42° C. It is understood however that equivalent stringencies may be achieved using alternative buffers, salts and temperatures. Additional guidance regarding hybridization conditions may be found in: Current Protocols in Molecular Biology, John Wiley & Sons, N.Y., 1989, 6.3.1.-6.3.6 and in: Sambrook et al., Molecular Cloning, a Laboratory Manual, Cold Spring Harbor Laboratory Press, 1989, Vol. 3.

The term "chimeric" as used herein in the context of nucleic acid sequences refers to at least two linked nucleic acid sequences, which are not naturally linked. Chimeric nucleic acid sequences include linked nucleic acid sequences of different natural origins. For example a nucleic acid sequence constituting a yeast promoter linked to a nucleic acid sequence encoding a CYP82Y1 protein is considered chimeric. Chimeric nucleic acid sequences also may comprise nucleic acid sequences of the same natural origin, provided they are not naturally linked. For example a nucleic acid sequence constituting a promoter obtained from a particular cell-type may be linked to a nucleic acid sequence encoding a polypeptide obtained from that same cell-type, but not normally linked to the nucleic acid sequence constituting the promoter. Chimeric nucleic acid sequences also include nucleic acid sequences comprising any naturally occurring nucleic acid sequence linked to any non-naturally occurring nucleic acid sequence.

The terms "substantially pure" and "isolated", as may be used interchangeably herein describe a compound, e.g., a pathway synthesis intermediate or a polypeptide, which has been separated from components that naturally accompany it. Typically, a compound is substantially pure when at least 60%, more preferably at least 75%, more preferably at least 90%, 95%, 96%, 97%, or 98%, and most preferably at least 99% of the total material (by volume, by wet or dry weight, or by mole percent or mole fraction) in a sample is the compound of interest. Purity can be measured by any appropriate method, e.g., in the case of polypeptides, by chromatography, gel electrophoresis or HPLC analysis.

The term "in vivo" as used herein to describe methods of making noscapine or noscapine synthesis intermediates refers to contacting a noscapine pathway precursor with an enzyme capable of catalyzing conversion of a noscapine precursor within a living cell, including, for example, a microbial cell or a plant cell, to form a noscapine synthesis intermediate or noscapine.

The term "in vitro" as used herein to describe methods of making noscapine or noscapine synthesis intermediates refers to contacting a noscapine pathway precursor with an enzyme capable of catalyzing conversion of a noscapine precursor in an environment outside a living cell, including, without limitation, for example, in a microwell plate, a tube, a flask, a beaker, a tank, a reactor and the like, to form a noscapine synthesis intermediate or noscapine.

General Implementation

Noscapine Synthesis

In one embodiment of the disclosure there is provided a method making noscapine. Accordingly, there is provided a method of making noscapine comprising:
(a) providing a canadine derivative, a papaveroxine derivative or narcotine hemiacetal; and
(b) contacting the canadine derivative, the papaveroxine derivative or narcotine hemiacetal with at least one of the enzymes selected from the group of enzymes consisting of (i) CYP82Y1; (ii) CYP82X2; (iii) AT1; (iv) CYP82X1; (v) OMT; (vi) CXE1; and (vii) NOS under reaction conditions permitting the catalysis of the canadine derivative, the papaveroxine derivative or narcotine hemiacetal to form noscapine;

and wherein the canadine derivative has the chemical formula (I) and the papaveroxine derivative has the chemical formula (III).

In a further embodiment, there is provided a method of making noscapine comprising:
(a) providing (S)—N-methylcanadine; and
(b) contacting (S)—N-methylcanadine with a mixture comprising catalytic quantities of the enzymes (i) CYP82Y1; (ii) CYP82X2; (iii) AT1; (iv) CYP82X1; (v) OMT; (vi) CXE1; and (vii) NOS under reaction conditions permitting an enzyme catalyzed chemical conversion of (S)—N-methylcanadine to noscapine.

In a further embodiment, there is provided a method of making noscapine comprising:
(a) providing 1-hydroxy-N-methylcanadine; and
(b) contacting 1-hydroxy-N-methylcanadine with a mixture comprising catalytic quantities of the enzymes (i) CYP82X2; (ii) AT1; (iii) CYP82X1; (iv) OMT; (v) CXE1; and (vi) NOS under reaction conditions permitting an enzyme catalyzed chemical conversion of 1-hydroxy-N-methylcanadine to noscapine.

In a further embodiment, there is provided a method of making noscapine comprising:
(a) providing 1,13-dihydroxy-N-methylcanadine; and
(b) contacting 1,13-dihydroxy-N-methylcanadine with a mixture comprising catalytic quantities of the enzymes (i) AT1; (ii) CYP82X1; (iii) OMT; (iv) CXE1; and (v) NOS under reaction conditions permitting an enzyme catalyzed chemical conversion of 1,13-dihydroxy-N-methylcanadine to noscapine.

In a further embodiment, there is provided a method of making noscapine comprising:
(a) providing 1-hydroxy-13-O-acetyl-N-methylcanadine; and
(b) contacting 1-hydroxy-13-O-acetyl-N-methylcanadine with a mixture comprising catalytic quantities of the enzymes (i) CYP82X1; (ii) OMT; (iii) CXE1; and (iv) NOS under reaction conditions permitting an enzyme catalyzed chemical conversion of 1-hydroxy-13-O-acetyl-N-methylcanadine to noscapine.

In a further embodiment, there is provided a method of making noscapine comprising:
(a) providing 1,8-dihydroxy-13-O-acetyl-N-methylcanadine; and
(b) contacting 1,8-dihydroxy-13-O-acetyl-N-methylcanadine with a mixture comprising catalytic quantities of the enzymes (i) OMT; (ii) CXE1; and (iii) NOS under reaction conditions permitting an enzyme catalyzed chemical conversion of 1,8-dihydroxy-13-O-acetyl-N-methylcanadine to noscapine.

In a further embodiment, there is provided a method of making noscapine comprising:
(a) providing 4'-O-desmethoxy-3-O-acetyl-N-papaveroxine; and
(b) contacting 4'-O-desmethoxy-3-O-acetyl-N-papaveroxine with a mixture comprising catalytic quantities of the enzymes (i) OMT; (ii) CXE1; and (iii) NOS under reaction conditions permitting an enzyme catalyzed chemical conversion of 4'-O-desmethoxy-3-O-acetyl-N-papaveroxine to noscapine.

In a further embodiment, there is provided a method of making noscapine comprising:
(a) providing 3-O-acetyl-N-papaveroxine; and
(b) contacting 3-O-acetyl-N-papaveroxine with a mixture comprising catalytic quantities of the enzymes (i) CXE1; and (ii) NOS under reaction conditions permitting an enzyme catalyzed chemical conversion of 3-O-acetyl-N-papaveroxine to noscapine.

In a further embodiment, there is provided a method of making noscapine comprising:
(a) providing papaveroxine; and
(b) contacting papaveroxine with a mixture comprising catalytic quantities of the enzyme NOS under reaction conditions permitting an enzyme catalyzed chemical conversion of papaveroxine to noscapine.

In a further embodiment there is provided a method of making noscapine comprising:
(a) providing narcotine hemiacetal; and
(b) contacting narcotine hemiacetal with catalytic quantities of the enzyme NOS under reaction conditions permitting an enzyme catalyzed chemical conversion of narcotine hemiacetal to noscapine.

The foregoing embodiments of the disclosure to make noscapine are further illustrated in Table A.

The foregoing reactions may be performed under in vivo or in vitro conditions as hereinafter further detailed.

Narcotine Hemiacetal Synthesis

In one embodiment of the disclosure, there is provided a method making narcotine hemiacetal. Accordingly, there is provided a method of making narcotine hemiacetal comprising:
(a) providing a canadine derivative or a papaveroxine derivative; and
(b) contacting the canadine derivative, or the papaveroxine derivative with at least one of the enzymes selected from the group of enzymes consisting of (i) CYP82Y1; (ii) CYP82X2; (iii) AT1; (iv) CYP82X1; (v) OMT; and (vi) CXE1 under reaction conditions permitting the catalysis of the canadine derivative or the papaveroxine derivative to form narcotine hemiacetal;
and wherein the canadine derivative has the chemical formula (I) and the papaveroxine derivative has the chemical formula (III).

In a further embodiment, there is provided a method of making narcotine hemiacetal comprising:
(a) providing (S)—N-methylcanadine; and
(b) contacting (S)—N-methylcanadine with a mixture comprising catalytic quantities of the enzymes (i) CYP82Y1; (ii) CYP82X2; (iii) AT1; (iv) CYP82X1; (v) OMT; and (vi) CXE1 under reaction conditions permitting an enzyme catalyzed chemical conversion of (S)—N-methylcanadine to narcotine hemiacetal.

In a further embodiment, there is provided a method of making narcotine hemiacetal comprising:
(a) providing 1-hydroxy-N-methylcanadine; and
(b) contacting 1-hydroxy-N-methylcanadine with a mixture comprising catalytic quantities of the enzymes (i) CYP82X2; (ii) AT1; (iii) CYP82X1; (iv) OMT; and (v) CXE1 under reaction conditions permitting an enzyme catalyzed chemical conversion of 1-hydroxy-N-methylcanadine to narcotine hemiacetal.

In a further embodiment, there is provided a method of making narcotine hemiacetal comprising:
(a) providing 1,13-dihydroxy-N-methylcanadine; and
(b) contacting 1,13-dihydroxy-N-methylcanadine with a mixture comprising catalytic quantities of the enzymes (i) AT1; (ii) CYP82X1; (iii) OMT; and (iv) CXE1 under reaction conditions permitting an enzyme catalyzed chemical conversion of 1,13-dihydroxy-N-methylcanadine to narcotine hemiacetal.

In a further embodiment, there is provided a method of making narcotine hemiacetal comprising:
(a) providing 1-hydroxy-13-O-acetyl-N-methylcanadine; and
(b) contacting 1-hydroxy-13-O-acetyl-N-methylcanadine with a mixture comprising catalytic quantities of the enzymes (i) CYP82X1; (ii) OMT; and (iii) CXE1 under reaction conditions permitting an enzyme catalyzed chemical conversion of 1-hydroxy-13-O-acetyl-N-methylcanadine to narcotine hemiacetal.

In a further embodiment, there is provided a method of making narcotine hemiacetal comprising:
(a) providing 1,8-dihydroxy-13-O-acetyl-N-methylcanadine; and
(b) contacting 1,8-dihydroxy-13-O-acetyl-N-methylcanadine with a mixture comprising catalytic quantities of the enzymes (i) OMT and (ii) CXE1 under reaction conditions permitting an enzyme catalyzed chemical conversion of 1,8-dihydroxy-13-O-acetyl-N-methylcanadine to narcotine hemiacetal.

In a further embodiment, there is provided a method of making narcotine hemiacetal comprising:
(a) providing 4'-O-desmethoxy-3-O-acetyl-N-papaveroxine; and
(b) contacting 4'-O-desmethoxy-3-O-acetyl-N-papaveroxine with a mixture comprising catalytic quantities of the enzymes (i) OMT and (ii) CXE1 under reaction conditions permitting an enzyme catalyzed chemical conversion of 4'-O-desmethoxy-3-O-acetyl-N-papaveroxine to narcotine hemiacetal.

In a further embodiment, there is provided a method of making narcotine hemiacetal comprising:
  (a) providing 3-O-acetyl-N-papaveroxine; and
  (b) contacting 3-O-acetyl-N-papaveroxine with catalytic quantities of the enzyme CXE1 under reaction conditions permitting an enzyme catalyzed chemical conversion of 3-O-acetyl-N-papaveroxine to narcotine hemiacetal.

In a further embodiment, there is provided a method of making narcotine hemiacetal comprising:
  providing papaveroxine under reaction conditions permitting a spontaneous chemical conversion of papaveroxine to narcotine hemiacetal.

The foregoing embodiments of the disclosure to make narcotine hemiacetal are further illustrated in Table B.

The foregoing reactions may be performed under in vivo or in vitro conditions as hereinafter further detailed.

Papaveroxine Synthesis

In one embodiment of the disclosure there is provided a method making papaveroxine. Accordingly, there is provided a method of making papaveroxine comprising:
  (a) providing a canadine derivative or a papaveroxine derivative; and
  (b) contacting the canadine derivative, or the papaveroxine derivative with at least one of the enzymes selected from the group of enzymes consisting of (i) CYP82Y1; (ii) CYP82X2; (iii) AT1; (iv) CYP82X1; (v) OMT; and (vi) CXE1 under reaction conditions permitting the catalysis of the canadine derivative or the papaveroxine derivative to form papaveroxine;
  and wherein the canadine derivative has the chemical formula (I) and the papaveroxine derivative has the chemical formula (IV)

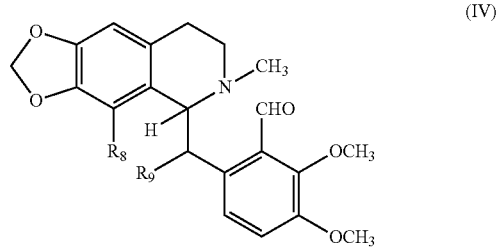

(IV)

wherein $R_8$ represents hydroxyl or methoxy; and
wherein $R_9$ represents O-acetyl.

In a further embodiment, there is provided a method of making papaveroxine comprising:
  (a) providing (S)—N-methylcanadine; and
  (b) contacting (S)—N-methylcanadine with a mixture comprising catalytic quantities of the enzymes (i) CYP82Y1; (ii) CYP82X2; (iii) AT1; (iv) CYP82X1; (v) OMT; and (vi) CXE1 under reaction conditions permitting an enzyme catalyzed chemical conversion of (S)—N-methylcanadine to papaveroxine.

In a further embodiment, there is provided a method of making papaveroxine comprising:
  (a) providing 1-hydroxy-N-methylcanadine; and
  (b) contacting 1-hydroxy-N-methylcanadine with a mixture comprising catalytic quantities of the enzymes (i) CYP82X2; (ii) AT1; (iii) CYP82X1; (iv) OMT; and (v) CXE1 under reaction conditions permitting an enzyme catalyzed chemical conversion of 1-hydroxy-N-methylcanadine to papaveroxine.

In a further embodiment, there is provided a method of making papaveroxine comprising:
  (a) providing 1,13-dihydroxy-N-methylcanadine; and
  (b) contacting 1,13-dihydroxy-N-methylcanadine with a mixture comprising catalytic quantities of the enzymes (i) AT1; (ii) CYP82X1; (iii) OMT; and (iv) CXE1 under reaction conditions permitting an enzyme catalyzed chemical conversion of 1,13-dihydroxy-N-methylcanadine to papaveroxine.

In a further embodiment, there is provided a method of making papaveroxine comprising:
  (a) providing 1-hydroxy-13-O-acetyl-N-methylcanadine; and
  (b) contacting 1-hydroxy-13-O-acetyl-N-methylcanadine with a mixture comprising catalytic quantities of the enzymes (i) CYP82X1; (ii) OMT; and (iii) CXE1 under reaction conditions permitting an enzyme catalyzed chemical conversion of 1-hydroxy-13-O-acetyl-N-methylcanadine to papaveroxine.

In a further embodiment, there is provided a method of making papaveroxine comprising:
  (a) providing 1,8-dihydroxy-13-O-acetyl-N-methylcanadine; and
  (b) contacting 1,8-dihydroxy-13-O-acetyl-N-methylcanadine with a mixture comprising catalytic quantities of the enzymes (i) OMT and (ii) CXE1 under reaction conditions permitting an enzyme catalyzed chemical conversion of 1,8-dihydroxy-13-O-acetyl-N-methylcanadine to papaveroxine.

In a further embodiment, there is provided a method of making papaveroxine comprising:
  (a) providing 4'-O-desmethoxy-3-O-acetyl-N-papaveroxine; and
  (b) contacting 4'-O-desmethoxy-3-O-acetyl-N-papaveroxine with a mixture comprising catalytic quantities of the enzymes (i) OMT and (ii) CXE1 under reaction conditions permitting an enzyme catalyzed chemical conversion of 4'-O-desmethoxy-3-O-acetyl-N-papaveroxine to papaveroxine.

In a further embodiment, there is provided a method of making papaveroxine comprising:
  (a) providing 3-O-acetyl-N-papaveroxine; and
  (b) contacting 3-O-acetyl-N-papaveroxine with catalytic quantities of the enzyme CXE1 under reaction conditions permitting an enzyme catalyzed chemical conversion of 3-O-acetyl-N-papaveroxine to papaveroxine.

The foregoing embodiments of the disclosure to make narcotine hemiacetal are further illustrated in Table C.

The foregoing reactions may be performed under in vivo or in vitro conditions as hereinafter further detailed.

3-O-Acetylpapaveroxine Synthesis

In one embodiment of the disclosure there is provided a method making 3-O-acetyl-papaveroxine. Accordingly, there is provided a method of making 3-O-acetyl-papaveroxine comprising:
  (a) providing a canadine derivative or 4'-O-desmethoxy-3-O-acetylpapaveroxine; and
  (b) contacting the canadine derivative, or 4'-O-desmethoxy-3-O-acetylpapaveroxine with at least one of the enzymes selected from the group of enzymes consisting of (i) CYP82Y1; (ii) CYP82X2; (iii) AT1; (iv) CYP82X1; and (v) OMT under reaction conditions permitting the catalysis of the canadine derivative or 4'-O-desmethoxy-3-O-acetylpapaveroxine to form 3-O-acetyl-papaveroxine;

wherein the canadine derivative has the chemical formula (I).

In a further embodiment there is provided a method of making 3-O-acetyl-papaveroxine comprising:
(a) providing (S)—N-methylcanadine; and
(b) contacting (S)—N-methylcanadine with a mixture comprising catalytic quantities of the enzymes (i) CYP82Y1; (ii) CYP82X2; (iii) AT1; (iv) CYP82X1; and (v) OMT under reaction conditions permitting an enzyme catalyzed chemical conversion of (S)—N-methylcanadine to 3-O-acetyl-papaveroxine.

In a further embodiment, there is provided a method of making 3-O-acetyl-papaveroxine comprising:
(a) providing 1-hydroxy-N-methylcanadine; and
(b) contacting 1-hydroxy-N-methylcanadine with a mixture comprising catalytic quantities of the enzymes (i) CYP82X2; (ii) AT1; (iii) CYP82X1 and (iv) OMT under reaction conditions permitting an enzyme catalyzed chemical conversion of 1-hydroxy-N-methylcanadine to 3-O-acetyl-papaveroxine.

In a further embodiment, there is provided a method of making 3-O-acetyl-papaveroxine comprising:
(a) providing 1,13-dihydroxy-N-methylcanadine; and
(b) contacting 1,13-dihydroxy-N-methylcanadine with a mixture comprising catalytic quantities of the enzymes (i) AT1; (ii) CYP82X1; and (iii) OMT under reaction conditions permitting an enzyme catalyzed chemical conversion of 1,13-dihydroxy-N-methylcanadine to 3-O-acetyl-papaveroxine.

In a further embodiment, there is provided a method of making 3-O-acetyl-papaveroxine comprising:
(a) providing 1-hydroxy-13-O-acetyl-N-methylcanadine; and
(b) contacting 1-hydroxy-13-O-acetyl-N-methylcanadine with a mixture comprising catalytic quantities of the enzymes (i) CYP82X1 and (ii) OMT under reaction conditions permitting an enzyme catalyzed chemical conversion of 1-hydroxy-13-O-acetyl-N-methylcanadine to 3-O-acetyl-papaveroxine.

In a further embodiment, there is provided a method of making 3-O-acetyl-papaveroxine comprising:
(a) providing 1,8-dihydroxy-13-O-acetyl-N-methylcanadine; and
(b) contacting 1,8-dihydroxy-13-O-acetyl-N-methylcanadine with a mixture comprising catalytic quantities of the enzyme OMT under reaction conditions permitting an enzyme catalyzed chemical conversion of 1,8-dihydroxy-13-O-acetyl-N-methylcanadine to 3-O-acetyl-papaveroxine.

In a further embodiment, there is provided a method of making 3-O-acetyl-papaveroxine comprising:
(a) providing 4'-O-desmethoxy-3-O-acetyl-N-papaveroxine; and
(b) contacting 4'-O-desmethoxy-3-O-acetyl-N-papaveroxine with catalytic quantities of the enzyme OMT and under reaction conditions permitting an enzyme catalyzed chemical conversion of 4'-O-desmethoxy-3-O-acetyl-N-papaveroxine to 3-O-acetylpapaveroxine.

The foregoing embodiments of the disclosure to make 3-O-acetyl-papaveroxine are further illustrated in Table D.

The foregoing reactions may be performed under in vivo or in vitro conditions as hereinafter further detailed.

4'-O-Desmethoxy-3-O-Acetylpapaveroxine Synthesis

In one embodiment of the disclosure there is provided a method making 4'-O-desmethoxy-3-O-acetylpapaveroxine.

Accordingly, there is provided a method of making 4'-O-desmethoxy-3-O-acetylpapaveroxine comprising:
(a) providing a canadine derivative; and
(b) contacting the canadine derivative with at least one of the enzymes selected from the group of enzymes consisting of (i) CYP82Y1; (ii) CYP82X2; (iii) AT1; and (iv) CYP82X1 under reaction conditions permitting the catalysis of the canadine derivative to form 4'-O-desmethoxy-3-O-acetylpapaveroxine;
and wherein the canadine derivative has the chemical formula (I).

In a further embodiment, there is provided a method of making 4'-O-desmethoxy-3-O-acetylpapaveroxine comprising:
(a) providing (S)—N-methylcanadine; and
(b) contacting (S)—N-methylcanadine with a mixture comprising catalytic quantities of the enzymes (i) CYP82Y1; (ii) CYP82X2; (iii) AT1; and (iv) CYP82X1 under reaction conditions permitting an enzyme catalyzed chemical conversion of (S)—N-methylcanadine to 4'-O-desmethoxy-3-O-acetylpapaveroxine.

In a further embodiment, there is provided a method of making 4'-O-desmethoxy-3-O-acetylpapaveroxine comprising:
(a) providing 1-hydroxy-N-methylcanadine; and
(b) contacting 1-hydroxy-N-methylcanadine with a mixture comprising catalytic quantities of the enzymes (i) CYP82X2; (ii) AT1; and (iii) CYP82X1 under reaction conditions permitting an enzyme catalyzed chemical conversion of 1-hydroxy-N-methylcanadine to 4'-O-desmethoxy-3-O-acetylpapaveroxine.

In a further embodiment, there is provided a method of making 4'-O-desmethoxy-3-O-acetylpapaveroxine comprising:
(a) providing 1,13-dihydroxy-N-methylcanadine; and
(b) contacting 1,13-dihydroxy-N-methylcanadine with a mixture comprising catalytic quantities of the enzymes (i) AT1; and (ii) CYP82X1; under reaction conditions permitting an enzyme catalyzed chemical conversion of 1,13-dihydroxy-N-methylcanadine to 4'-O-desmethoxy-3-O-acetylpapaveroxine.

In a further embodiment, there is provided a method of making 4'-O-desmethoxy-3-O-acetylpapaveroxine comprising:
(a) providing 1-hydroxy-13-O-acetyl-N-methylcanadine; and
(b) contacting 1-hydroxy-13-O-acetyl-N-methylcanadine with a mixture comprising catalytic quantities of the enzyme CYP82X1 under reaction conditions permitting an enzyme catalyzed chemical conversion of 1-hydroxy-13-O-acetyl-N-methylcanadine to 4'-O-desmethoxy-3-O-acetylpapaveroxine.

In a further embodiment, there is provided a method of making 4'-O-desmethoxy-3-O-acetyl-papaveroxine comprising:
providing 1,8-dihydroxy-13-O-acetyl-N-methyl-canadine under reaction conditions permitting a spontaneous chemical conversion of 1,8-dihydroxy-13-O-acetyl-N-methyl-canadine to 4'-O-desmethoxy-3-O-acetyl-papaveroxine.

The foregoing embodiments of the present disclosure to make 4'-O-desmethoxy-3-O-papaveroxine are further illustrated in Table E.

The foregoing reactions may be performed under in vivo or in vitro conditions as hereinafter further detailed.

1,8-Dihydroxy-13-O-Acetyl-N-Methylcanadine Synthesis

In one embodiment of the disclosure there is provided a method making 1,8-dihydroxy-13-O-acetyl-N-methylcanadine. Accordingly, there is provided a method of making 1,8-dihydroxy-13-O-acetyl-N-methylcanadine comprising:
(a) providing a canadine derivative; and
(b) contacting the canadine derivative with at least one of the enzymes selected from the group of enzymes consisting of (i) CYP82Y1; (ii) CYP82X2; (iii) AT1; and (iv) CYP82X1 under reaction conditions permitting the catalysis of the canadine derivative to form 1,8-dihydroxy-13-O-acetyl-N-methylcanadine;
and wherein the canadine derivative has the chemical formula (V):

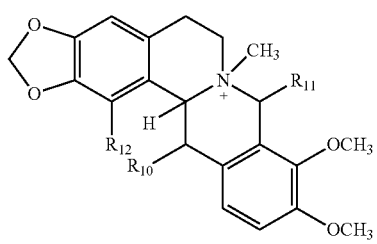

(V)

wherein $R_{10}$ represents a hydrogen atom, hydroxyl; or O-acetyl;
wherein $R_{11}$ represents a hydrogen atom; and
wherein $R_{12}$ represents a hydrogen atom or hydroxyl.

In a further embodiment there is provided a method of making 1,8-dihydroxy-13-O-acetyl-N-methylcanadine comprising:
(a) providing (S)—N-methylcanadine; and
(b) contacting (S)—N-methylcanadine with a mixture comprising catalytic quantities of the enzymes (i) CYP82Y1; (ii) CYP82X2; (iii) AT1; and (iv) CYP82X1 under reaction conditions permitting an enzyme catalyzed chemical conversion of (S)—N-methylcanadine to 1,8-dihydroxy-13-O-acetyl-N-methylcanadine.

In a further embodiment, there is provided a method of making 1,8-dihydroxy-13-O-acetyl-N-methylcanadine comprising:
(a) providing 1-hydroxy-N-methylcanadine; and
(b) contacting 1-hydroxy-N-methylcanadine with a mixture comprising catalytic quantities of the enzymes (i) CYP82X2; (ii) AT1; and (iii) CYP82X1 under reaction conditions permitting an enzyme catalyzed chemical conversion of 1-hydroxy-N-methyl-canadine to 1,8-dihydroxy-13-O-acetyl-N-methylcanadine.

In a further embodiment, there is provided a method of making 1,8-dihydroxy-13-O-acetyl-N-methylcanadine comprising:
(a) providing 1,13-dihydroxy-N-methylcanadine; and
(b) contacting 1,13-dihydroxy-N-methylcanadine with a mixture comprising catalytic quantities of the enzymes (i) AT1; and (ii) CYP82X1; under reaction conditions permitting an enzyme catalyzed chemical conversion of 1,13-dihydroxy-N-methylcanadine to 1,8-dihydroxy-13-O-acetyl-N-methylcanadine.

In a further embodiment, there is provided a method of making 1,8-dihydroxy-13-O-acetyl-N-methylcanadine comprising:
(a) providing 1-hydroxy-13-O-acetyl-N-methylcanadine; and
(b) contacting 1-hydroxy-13-O-acetyl-N-methylcanadine with catalytic quantities of the enzyme CYP82X1 under reaction conditions permitting an enzyme catalyzed chemical conversion of 1-hydroxy-13-O-acetyl-N-methylcanadine to 1,8-dihydroxy-13-O-acetyl-N-methylcanadine.

The foregoing embodiments of the present disclosure to make 1,8-dihydroxy-13-O-acetyl-N-methylcanadine are further illustrated in Table F.

The foregoing reactions may be performed under in vivo or in vitro conditions as hereinafter further detailed.

1-Hydroxy-13-O-Acetyl-N-Methylcanadine Synthesis

In one embodiment of the disclosure there is provided a method making 1-hydroxy-13-O-acetyl-N-methylcanadine. Accordingly there is provided a method of making 1-hydroxy-13-O-acetyl-N-methylcanadine comprising:
(a) providing a canadine derivative; and
(b) contacting the canadine derivative with at least one of the enzymes selected from the group of enzymes consisting of (i) CYP82Y1; (ii) CYP82X2; and (iii) AT1 under reaction conditions permitting the catalysis of the canadine derivative to form 1-hydroxy-13-O-acetyl-N-methylcanadine;
and wherein the canadine derivative has the chemical formula (VI):

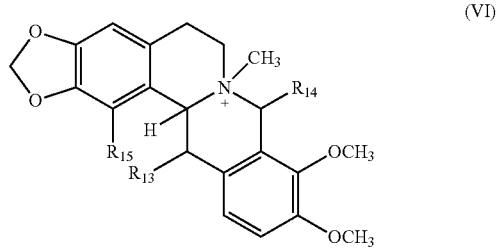

(VI)

wherein $R_{13}$ represents a hydrogen atom or hydroxyl;
wherein $R_{14}$ represents a hydrogen atom; and
wherein $R_{15}$ represents a hydrogen atom or hydroxyl.

In a further embodiment there is provided a method of making 1-hydroxy-13-O-acetyl-N-methylcanadine comprising:
(a) providing (S)—N-methylcanadine; and
(b) contacting (S)—N-methylcanadine with a mixture comprising catalytic quantities of the enzymes (i) CYP82Y1; (ii) CYP82X2; and (iii) AT1 under reaction conditions permitting an enzyme catalyzed chemical conversion of (S)—N-methylcanadine to 1-hydroxy-13-O-acetyl-N-methylcanadine.

In a further embodiment there is provided a method of making 1-hydroxy-13-O-acetyl-N-methylcanadine comprising:
(a) providing 1-hydroxy-N-methylcanadine; and
(b) contacting 1-hydroxy-N-methylcanadine with a mixture comprising catalytic quantities of the enzymes (i) CYP82X2 and (ii) AT1 under reaction conditions permitting an enzyme catalyzed chemical conversion of 1-hydroxy-N-methyl-canadine to 1-hydroxy-13-O-acetyl-N-methylcanadine.

In a further embodiment there is provided a method of making 1-hydroxy-13-O-acetyl-N-methylcanadine comprising:
(a) providing 1,13-dihydroxy-N-methylcanadine; and
(b) contacting 1,13-dihydroxy-N-methylcanadine with catalytic quantities of the enzyme AT1 under reaction conditions permitting an enzyme catalyzed chemical conversion of 1,13-dihydroxy-N-methylcanadine to 1-hydroxy-13-O-acetyl-N-methylcanadine.

The foregoing embodiments of the present disclosure to make 1-hydroxy-13-O-acetyl-N-methylcanadine are further illustrated in Table G.

The foregoing reactions may be performed under in vivo or in vitro conditions as hereinafter further detailed.

1,13-Dihydroxy-N-Methylcanadine Synthesis

In one embodiment of the disclosure there is provided a method making 1,13-dihydroxy-N-methylcanadine. Accordingly, there is provided a method of making 1,13-dihydroxy-N-methylcanadine comprising:
(a) providing a canadine derivative; and
(b) contacting the canadine derivative with at least one of the enzymes selected from the group of enzymes consisting of (i) CYP82Y1 and (ii) CYP82X2 under reaction conditions permitting the catalysis of the canadine derivative to form 1,13-dihydroxy-N-methylcanadine;
and wherein the canadine derivative has the chemical formula (VII):

(VII)

wherein $R_{16}$ represents a hydrogen atom;
wherein $R_{17}$ represents a hydrogen atom; and
wherein $R_{18}$ represents a hydrogen atom or hydroxyl.

In a further embodiment there is provided a method of making 1,13-dihydroxy-N-methylcanadine comprising:
(a) providing (S)—N-methylcanadine; and
(b) contacting (S)—N-methylcanadine with a mixture comprising catalytic quantities of the enzymes (i) CYP82Y1; and (ii) CYP82X2 under reaction conditions permitting an enzyme catalyzed chemical conversion of (S)—N-methylcanadine to 1,13-dihydroxy-N-methylcanadine.

In a further embodiment, there is provided a method of making 1,13-dihydroxy-N-methylcanadine comprising:
(a) providing 1-hydroxy-N-methylcanadine; and
(b) contacting 1-hydroxy-N-methylcanadine with catalytic quantities of the enzyme CYP82X2 under reaction conditions permitting an enzyme catalyzed chemical conversion of 1-hydroxy-N-methyl-canadine to 1,13-dihydroxy-N-methylcanadine.

The foregoing embodiments of the present disclosure to make 1-hydroxy-13-O-acetyl-N-methylcanadine are further illustrated in Table H.

The foregoing reactions may be performed under in vivo or in vitro conditions as hereinafter further detailed.

1-Hydroxy-N-Methylcanadine Synthesis

In one embodiment of the disclosure there is provided a method making 1-hydroxy-N-methylcanadine. Accordingly, there is provided a method of making 1-hydroxy-N-methylcanadine comprising:
(a) providing (S)—N-methylcanadine; and
(b) contacting (S)—N-methylcanadine with the enzyme CYP82Y1 under reaction conditions permitting the catalysis of the canadine derivative to form 1-hydroxy-N-methylcanadine;

In a further embodiment, there is provided a method of making 1-hydroxy-N-methylcanadine comprising:
(a) providing (S)—N-methylcanadine; and
(b) contacting (S)—N-methylcanadine with catalytic quantities of the enzymes CYP82Y1 under reaction conditions permitting an enzyme catalyzed chemical conversion of (S)—N-methylcanadine to 1-hydroxy-N-methylcanadine.

The foregoing embodiments of the present disclosure to make 1-hydroxy-13-O-acetyl-N-methylcanadine are further illustrated in Table I.

The foregoing reactions may be performed under in vivo or in vitro conditions as hereinafter further detailed.

Noscapine Synthesis Intermediate Derivatives

In addition to the noscapine synthesis intermediates shown in FIG. 1, it is noted that in certain embodiments hereof, certain derivatives of the noscapine synthesis intermediates shown in FIG. 1 may also be prepared. Thus, for example, narcotoline hemiacetal and narcotinoline may be prepared by providing CYP82X1, as hereinafter set forth and shown in FIG. 22.

Narcotoline Hemiacetal Synthesis

In one embodiment of the disclosure, there is provided a method making narcotinoline hemiacetal. Accordingly, there is provided a method of making narcotinoline hemiacetal comprising:
(a) providing a canadine derivative; and
(b) contacting the canadine derivative with at least one of the enzymes selected from the group of enzymes consisting of (i) CYP82Y1; (ii) CYP82X2; (iii) AT1; and (iv) CYP82X1; and, optionally, (v) CXE1 under reaction conditions permitting the catalysis of the canadine derivative to form narcotinoline hemiacetal;
and wherein the canadine derivative has the chemical formula (I).

In a further embodiment, there is provided a method of making narcotinoline hemiacetal comprising:
(a) providing (S)—N-methylcanadine; and
(b) contacting (S)—N-methylcanadine with a mixture comprising catalytic quantities of the enzymes (i) CYP82Y1; (ii) CYP82X2; (iii) AT1; and (iv) CYP82X1 under reaction conditions permitting an enzyme catalyzed chemical conversion of (S)—N-methylcanadine to narcotinoline hemiacetal.

In a further embodiment, there is provided a method of making narcotinoline hemiacetal comprising:
(a) providing 1-hydroxy-N-methylcanadine; and
(b) contacting 1-hydroxy-N-methylcanadine with a mixture comprising catalytic quantities of the enzymes (i) CYP82X2; (ii) AT1; and (iii) CYP82X1; and, optionally, (iv) CXE1 under reaction conditions permitting an enzyme catalyzed chemical conversion of 1-hydroxy-N-methylcanadine to narcotinoline hemiacetal.

In a further embodiment, there is provided a method of making narcotinoline hemiacetal comprising:
(a) providing 1,13-dihydroxy-N-methylcanadine; and
(b) contacting 1,13-dihydroxy-N-methylcanadine with a mixture comprising catalytic quantities of the enzymes (i) AT1; and (ii) CYP82X1; under reaction conditions permitting an enzyme catalyzed chemical conversion of 1,13-dihydroxy-N-methylcanadine to narcotinoline hemiacetal.

In a further embodiment, there is provided a method of making narcotinoline hemiacetal comprising:
(a) providing 1-hydroxy-13-O-acetyl-N-methylcanadine; and
(b) contacting 1-hydroxy-13-O-acetyl-N-methylcanadine with a mixture comprising catalytic quantities of the enzyme CYP82X1, and, optionally, CXE1, under reaction conditions permitting an enzyme catalyzed chemical conversion of 1-hydroxy-13-O-acetyl-N-methylcanadine to narcotinoline hemiacetal.

In a further embodiment, there is provided a method of making narcotinoline hemiacetal comprising:
(a) providing 1-hydroxy-13-O-acetyl-N-methylcanadine; and
(b) contacting 1-hydroxy-13-O-acetyl-N-methylcanadine with a mixture comprising catalytic quantities of the enzyme CXE1, under reaction conditions permitting an enzyme catalyzed chemical conversion of 1-hydroxy-13-O-acetyl-N-methylcanadine to narcotinoline hemiacetal.

In a further embodiment, there is provided a method of making narcotinoline hemiacetal comprising:
(a) providing 4'-desmethoxy-3-O-acetyl-papaveroxine; and
(b) contacting 4'-desmethoxy-3-O-acetyl-papaveroxine with a mixture comprising catalytic quantities of the enzyme CXE1, under reaction conditions permitting an enzyme catalyzed chemical conversion of 4'-desmethoxy-3-O-acetyl-papaveroxine to narcotinoline hemiacetal.

In a further embodiment, there is provided a method of making narcotinoline hemiacetal comprising:
providing 1,8-dihydroxy-13-O-acetyl-N-methyl-canadine under reaction conditions permitting a spontaneous chemical conversion of 1,8-dihydroxy-13-O-acetyl-N-methyl-canadine to narcotinoline hemiacetal.

In a further embodiment, there is provided a method of making narcotinoline hemiacetal comprising:
providing 4'-desmethoxy-3-O-acetyl-papaveroxine under reaction conditions permitting a spontaneous chemical conversion of 4'-desmethoxy-3-O-acetyl-papaveroxine to narcotinoline hemiacetal.

In a further embodiment, there is provided a method of making narcotinoline hemiacetal comprising:
providing 4-desmethoxy-papaveroxine under reaction conditions permitting a spontaneous chemical conversion of 4'-desmethoxy-3-O-acetyl-papaveroxine canadine to narcotinoline hemiacetal.

The foregoing embodiments of the present disclosure to make narcotinoline hemiacetal are further illustrated in Table J.

The foregoing reactions may be performed under in vivo or in vitro conditions as hereinafter further detailed.

Narcotinoline Synthesis

Figure 22:
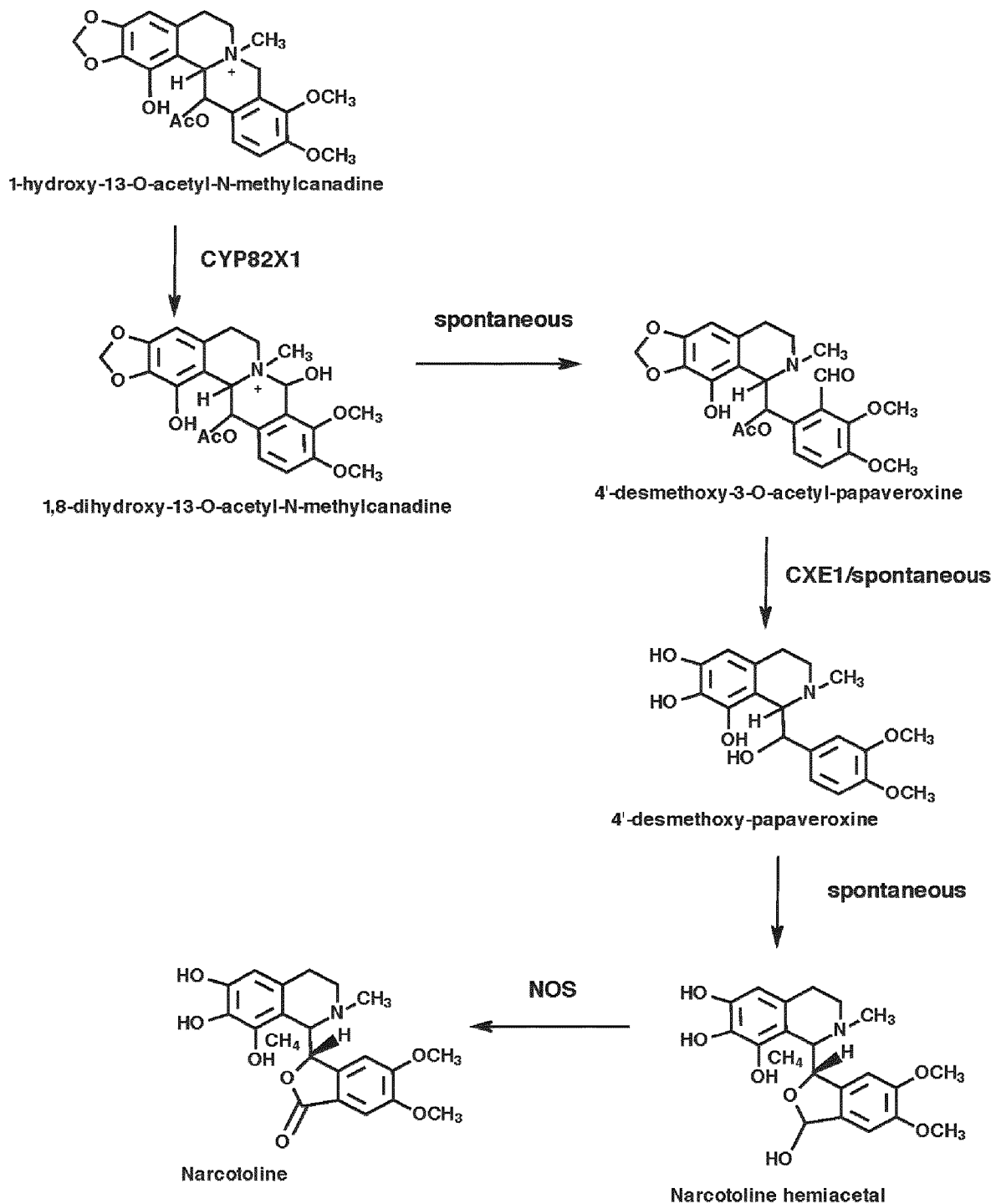
FIG. 22 depicts a synthesis pathway for the manufacture of narcotoline and narcotoline hemiacetal and synthesis intermediates thereof. Included are the chemical structures of the synthesis intermediates and enzymes capable of catalyzing chemical conversion of the synthesis intermediates.

In another embodiment hereof, narcotinoline hemiacetal in the presence of NOS may be converted to narcotinoline (as shown in FIG. 22).

In one embodiment of the disclosure, there is provided a method making narcotinoline. Accordingly, there is provided a method of making narcotoline comprising:
(a) providing a canadine derivative; and
(b) contacting the canadine derivative with at least one of the enzymes selected from the group of enzymes consisting of (i) CYP82Y1; (ii) CYP82X2; (iii) AT1; (iv) CYP82X1 and (v) NOS; and (vi), optionally, CXE1, under reaction conditions permitting the catalysis of the canadine derivative to form narcotinoline;
and wherein the canadine derivative has the chemical formula (I).

In a further embodiment, there is provided a method of making narcotinoline comprising:
(a) providing (S)—N-methylcanadine; and
(b) contacting (S)—N-methylcanadine with a mixture comprising catalytic quantities of the enzymes (i) CYP82Y1; (ii) CYP82X2; (iii) AT1; (iv) CYP82X1 and (v) NOS; and (vi), optionally, CXE1, under reaction conditions permitting an enzyme catalyzed chemical conversion of (S)—N-methylcanadine to narcotinoline.

In a further embodiment, there is provided a method of making narcotinoline comprising:
(a) providing 1-hydroxy-N-methylcanadine; and
(b) contacting 1-hydroxy-N-methylcanadine with a mixture comprising catalytic quantities of the enzymes (i) CYP82X2; (ii) AT1; and (iii) CYP82X1 and (iv) NOS; and (v), optionally, CXE1, under reaction conditions permitting an enzyme catalyzed chemical conversion of 1-hydroxy-N-methylcanadine to narcotinoline.

In a further embodiment, there is provided a method of making narcotinoline comprising:
(a) providing 1,13-dihydroxy-N-methylcanadine; and
(b) contacting 1,13-dihydroxy-N-methylcanadine with a mixture comprising catalytic quantities of the enzymes (i) AT1; and (ii) CYP82X1 and (iii) NOS; and (iv), optionally, CXE1, under reaction conditions permitting an enzyme catalyzed chemical conversion of 1,13-dihydroxy-N-methylcanadine to narcotinoline.

In a further embodiment, there is provided a method of making narcotinoline comprising:
(a) providing 1-hydroxy-13-O-acetyl-N-methylcanadine; and
(b) contacting 1-hydroxy-13-O-acetyl-N-methylcanadine with a mixture comprising catalytic quantities of the enzymes (i) CYP82X1 and (ii) NOS; and (iii), optionally, CXE1, under reaction conditions permitting an enzyme catalyzed chemical conversion of 1-hydroxy-13-O-acetyl-N-methylcanadine to narcotinoline.

In a further embodiment, there is provided a method of making narcotinoline comprising:
(a) providing 1,8-dihydroxy-13-O-acetyl-N-methylcanadine; and
(b) contacting 1,8-dihydroxy-13-O-acetyl-N-methylcanadine with a mixture comprising catalytic quantities of NOS and, optionally, CXE1, under reaction conditions permitting an enzyme catalyzed chemical conversion of 1,8-dihydroxy-13-O-acetyl-N-methylcanadine to narcotinoline.

In a further embodiment, there is provided a method of making narcotinoline comprising:
(a) providing 4'-desmethoxy-3-O-acetylpapaveroxine; and
(b) contacting 4'-desmethoxy-3-O-acetylpapaveroxine with a mixture comprising catalytic quantities of NOS and, optionally, CXE1, under reaction conditions permitting an enzyme catalyzed chemical conversion of 4'-desmethoxy-3-O-acetylpapaveroxine to narcotinoline.

In a further embodiment, there is provided a method of making narcotinoline comprising:
(a) providing 4'desmethoxy papaveroxine; and
(b) contacting 4'-desmethoxy-3-O-acetylpapaveroxine with a mixture comprising catalytic quantities of NOS under reaction conditions permitting an enzyme catalyzed chemical conversion of 4'-desmethoxy-3-O-acetylpapaveroxine to narcotinoline.

The foregoing embodiments of the present disclosure to make narcotinoline are further illustrated in Table K.

The foregoing reactions may be performed under in vivo or in vitro conditions as hereinafter further detailed.

In Vitro Synthesis of Noscapine, Noscapine Synthesis Intermediates and Noscapine Synthesis Intermediate Derivatives In accordance with certain aspects of the present disclosure, noscapine synthesis intermediates or noscapine synthesis intermediate derivatives are brought in contact with catalytic quantities of one or more of the enzymes CYP82Y1; CYP82X2; AT1; CYP82X1; OMT; CXE1 and NOS under reaction conditions permitting an enzyme catalyzed chemical conversion of the noscapine synthesis intermediates or noscapine synthesis intermediate derivatives under in vitro reaction conditions. Under such in vitro reaction conditions the initial reaction constituents are provided in more or less pure form and are mixed under conditions that permit the requisite chemical reactions to substantially proceed. Substantially pure forms of the initial noscapine synthesis intermediates or noscapine synthesis intermediate derivatives may be chemically synthesized or, preferably, are isolated from natural sources including, *Papaver somniferum*. Other plant species that may be used in accordance herewith to obtain noscapine synthesis intermediate include, without limitation, plant species belonging to the plant families of Eupteleaceae, Lardizabalaceae, Circaeasteraceae, Menispermaceae, Berberidaceae, Ranunculaceae, and Papaveraceae (including those belonging to the subfamilies of Pteridophylloideae, Papaveroideae and Fumarioideae) and further includes plants belonging to the genus *Argemone*, including *Argemone mexicana* (Mexican Prickly Poppy), plants belonging to the genus *Berberis*, including *Berberis thunbergii* (Japanese Barberry), plants belonging to the genus *Chelidonium*, including *Chelidonium majus* (Greater Celandine), plants belonging to the genus *Cissampelos*, including *Cissampelos mucronate* (Abuta), plants belonging to the genus *Cocculus*, including *Cocculus trilobus* (Korean Moonseed), plants belonging to the genus *Corydalis*, including *Corydalis chelanthifolia* (Ferny Fumewort), *Corydalis cava; Corydalis ochotenis; Corydalis ophiocarpa; Corydalis platycarpa; Corydalis tuberosa* and *Cordyalis bulbosa*, plants belonging to the genus *Eschscholzia*, including *Eschscholzia californica* (California Poppy), plants belonging to the genus *Glaucium*, including *Glaucium flavum* (Yellowhorn Poppy), plants belonging to the genus *Hydrastis*, including *Hydrastis canadensis* (Goldenseal), plants belonging to the genus *Jeffersonia*, including *Jeffersonia diphylla* (Rheumatism Root), plants belonging to the genus *Mahonia*, including *Mahonia aquifolium* (Oregon Grape), plants belonging to the genus *Menispermum*, including *Menispermum canadense* (Canadian Moonseed), plants belonging to the genus *Nandina*, including *Nandina domestica* (Sacred Bamboo), plants belonging to the genus *Nigella*, including *Nigella sativa* (Black Cumin), plants belonging to the genus *Papaver*, including *Papaver armeniacum*, *Papaver bracteatum* (Persian Poppy), *Papaver somniferum*, *Papaver cylindricum*, *Papaver decaisnei*, *Papaver fugax*, *Papaver oreophyllum*, *Papaver orientale*, *Papaver paeonifolium*, *Papaver persicum*, *Papaver pseudo-orientale*, *Papaver rhoeas*, *Papaver rhopalothece*, *Papaver setigerum*, *Papaver tauricolum*, and *Papaver triniaefolium*, plants belonging to the genus *Sanguinaria*, including *Sanguinaria canadensis* (Bloodroot), plants belonging to the genus *Stylophorum*, including *Stylophorum diphyllum* (Celandine Poppy), plants belonging to the genus *Thalictrum*, including *Thalictrum flavum* (Meadow Rue), plants belonging to the genus *Tinospora*, including *Tinospora cordifolia* (Heartleaf Moonseed), plants belonging to the genus *Xanthoriza*, including *Xanthoriza simplicissima* (Yellowroot) and plants belonging to the genus *Romeria* including *Romeria carica*. The aforementioned plants may be able to produce noscapine synthesis intermediates, including, but not limited to 3-O-acetyl-papaveroxine, which may be obtained from the species selected from the group of species including, without limitation, *Papaver fugax; Papaver pseudo-orient* and *Papaver somniferum*; and, narcotine-hemiacetal, which may be obtained from the species selected from the group of species including, without limitation, *Papaver fugax; Papaver pseudo-orient* and *Papaver somniferum*. Chemical synthesis may be performed by direct condensation between cotarnine and meconine, or related methods using cotarnine intermediate. Alternatively, total synthesis of (+/−)-α-noscapine is achieved using blocking group-directed Bischler-Napieralski cyclization, followed with diastereoselective reduction. Initial synthesis and resolution of (dl)-noscapine, previously called gnoscapine or (dl)-narcotine, was reported by Perkin and Robinson (1911, J. Chem. Soc. Trans. 99: 775-792). Subsequent reports detailed the individual chemical syntheses of noscapine isomers, including both α and β configurations (Gorecki and Bognár 1968, Pharmazie 23:590-593; von Gaal and Bognár 1971, Journal für practische chemie 313: 935-939; Kerkekes and Bognár 1971, Journal für practische chemie 313: 923-934; Varga et al. 1991, Acta Chimica Hungarica: Models in Chemistry 138: 831-837). Recently, blocking group-directed diastereoselective total synthesis of (+/−)-α-noscapine was reported (Ni et al. 2011, Tetrahedron 67: 5162-5167). Chemical semi-syntheses of noscapine analogues, or "noscapinoids," have employed noscapine as a starting material. For example, folate conjugated noscapine (Targetin) (Naik et al. 2012, Journal of Computer Aided Molecular Design 26: 233-247.), aminated noscapinoids (Anderson et al. 2005, Journal of Medicinal Chemistry 48: 7096-7098.), benzofuranone ring- (Mishra et al. 2011, Biochemical Pharmacology 82: 110-121) and isoquinoline ring-substituted analogues (Aneja et al. 2006, Bioorganic and Medicinal Chemistry 14: 8352-8358; and Aggarwal et al. 2002 Helvetica Chimica Acta 85: 2458-2462).

In accordance herewith, more or less pure forms of the enzymes may be isolated from natural sources, including *Papaver somniferum*, or they may be prepared recombinantly. Thus, provided herein is further a method for preparing an enzyme selected from the group of enzymes consisting of CYP82Y1; CYP82X2; AT1; CYP82X1; OMT; CXE1 and NOS comprising:
(a) providing a chimeric nucleic acid sequence comprising in the 5' to 3' direction of transcription as operably linked components:
(i) one or more nucleic acid sequences encoding one or more of the polypeptides selected from the group of polypeptides consisting of CYP82Y1; CYP82X2; AT1; CYP82X1; OMT; CXE1 and NOS; and (ii) one or more nucleic acid sequences capable of controlling expression in a host cell;
(b) introducing the chimeric nucleic acid sequence into a host cell and growing the host cell to produce the polypeptide selected from the group of polypeptides consisting of CYP82Y1; CYP82X2; AT1; CYP82X1; OMT; CXE1 and/or NOS; and
(c) recovering CYP82Y1; CYP82X2; AT1; CYP82X1; OMT; CXE1 and NOS from the host cell.

In preferred embodiments the enzymes are polypeptides having a polypeptide sequence represented by SEQ.ID. NO.2; SEQ.ID. NO.4; SEQ.ID. NO.6; SEQ.ID. NO.8; SEQ.ID. NO.10; and SEQ.ID. NO.12.

Growth of the host cells leads to production of the CYP82Y1; CYP82X2; AT1; CYP82X1; OMT; CXE1 and/or NOS polypeptides. The polypeptides subsequently may be recovered, isolated and separated from other host cell components by a variety of different protein purification techniques including, e.g. ion-exchange chromatography, size exclusion chromatography, affinity chromatography, hydrophobic interaction chromatography, reverse phase chromatography, gel filtration, etc. Further general guidance with respect to protein purification may for example be found in: Cutler, P. Protein Purification Protocols, Humana Press, 2004, Second Ed. Thus substantially pure preparations of the CYP82Y1; CYP82X2; AT1; CYP82X1; OMT; CXE1 and/or NOS polypeptides may be obtained. Combinations of polypeptides may be selected in accordance with Tables A-K, and any and all of the combinations of the enzymes set forth in Tables A-K are specifically included herein.

In accordance herewith, noscapine synthesis intermediates or noscapine synthesis intermediate derivatives are brought in contact with catalytic quantities of one or more of the enzymes CYP82Y1; CYP82X2; AT1; CYP82X1; OMT; CXE1 and NOS under reaction conditions permitting an enzyme catalyzed chemical conversion of the noscapine synthesis intermediates or noscapine synthesis intermediate derivatives. In preferred embodiments, the agents are brought in contact with each other and mixed to form a mixture. In preferred embodiments the mixture is an aqueous mixture comprising water and further optionally additional agents to facilitate enzyme catalysis, including buffering agents, salts, pH modifying agents, as well as co-factors, for example NAD+ and NADP+. The reaction may be performed at a range of different temperatures. In preferred embodiments the reaction is performed at a temperature between about 18° C. and 37° C. It is furthermore noted that in certain instances where a reaction is proceeding spontaneously, as noted in FIG. 1 and FIG. 22, further optional additional agents include enzymes. Specifically it is noted that in accordance with the present disclosure, in order to facilitate conversion of 4'-desmethoxy-3-O-acetylpapaveroxine to 4'-desmethoxy-papaveroxine, the enzyme CXE1 may be included in the reaction mixture. Upon completion of the in vitro reaction noscapine or the noscapine synthesis intermediates or noscapine synthesis intermediate derivatives may be obtained in more or less pure form. It will be understood by those of skill in the art that the quantities of the secondary metabolites that are obtained may vary, and that depending on the exact reaction conditions selected, together with noscapine or a desired noscapine pathway precursor, compounds upstream thereof, as well as noscapine intermediate synthesis derivatives, may be obtained. In general, it will be possible to select, through routine optimization, the reaction conditions in such a manner that the presence of noscapine pathway precursor compounds, upstream of noscapine or the desired noscapine pathway precursor compound, or the presence of undesirable derivatives of noscapine synthesis intermediate derivatives is minimized.

In Vivo Synthesis of Noscapine and Noscapine Synthesis Intermediates and Noscapine Synthesis Intermediate Derivatives In accordance with certain aspects of the present disclosure noscapine synthesis intermediates or noscapine synthesis intermediate derivatives are brought in contact with catalytic quantities of one or more of the enzymes CYP82Y1; CYP82X2; AT1; CYP82X1; OMT; CXE1 and NOS under reaction conditions permitting an enzyme catalyzed chemical conversion of the noscapine synthesis intermediates or noscapine synthesis intermediate derivatives under in vivo reaction conditions. Under such in vivo reaction conditions living cells are modified in such a manner that they produce noscapine or the noscapine synthesis intermediates or noscapine synthesis intermediate derivatives. In certain embodiments, the living cells are microorganisms, including bacterial cells and fungal cells. In other embodiments the living cells are multicellular organisms, including plants.

In one embodiment, the living cells are selected to be host cells capable of producing at least one of the noscapine synthesis intermediates or noscapine synthesis intermediate derivatives of the present disclosure, but are unable to produce noscapine or one or more of noscapine or the other noscapine synthesis intermediates of the present disclosure. Such cells include, without limitation, bacteria, yeast, other fungal cells, plant cells, or animal cells. Thus, by way of example only, a host cell may be a yeast host cell capable of producing S—N-methylcanadine, but not any of 1-hydroxy-N-methylcanadine; 1,13-dihydroxy-N-methylcanadine; 1-hydroxy-O-acetyl-N-methylcanadine; 1,8-dihydroxy-13-O-acetyl-N-methylcanadine; 4'-O-desmethoxy-3-O-acetyl-papaveroxine; 3-O-acetyl-papaveroxine; papaveroxine; narcotine hemiacetal or noscapine. In order to modulate such host cells in such a manner that they produce noscapine or other noscapine synthesis intermediates, one or more of the enzymes selected from the group of enzymes consisting of CYP82Y1; CYP82X2; AT1; CYP82X1' OMT; CXE1 and NOS in accordance herewith may be heterologously introduced and expressed in the host cells.

In other embodiments, the living cells naturally produce one or more of the noscapine synthesis intermediates or noscapine synthesis intermediate derivatives or noscapine of the present disclosure, however the living cells are modulated in such a manner that the levels of one or more of the noscapine synthesis intermediates or noscapine synthesis intermediate derivatives or noscapine produced in the cells is modulated, without heterologous introduction of any of the aforementioned enzymes in such living cells.

In order to produce noscapine or a noscapine synthesis intermediate or a noscapine synthesis intermediate derivative, provided herein is further a method for preparing noscapine and/or one or more of the noscapine synthesis intermediates and/or or noscapine synthesis intermediate derivatives selected from the group of noscapine synthesis intermediates and noscapine synthesis intermediate derivatives consisting of: 1-hydroxy-N-methylcanadine; 1,13-dihydroxy-N-methylcanadine; 1-hydroxy-O-acetyl-N-methylcanadine; 1,8-dihydroxy-13-O-acetyl-N-methylcanadine; 4'-O-desmethoxy-3-O-acetyl-papaveroxine; 3-O-acetyl-papaveroxine; papaveroxine; narcotine hemiacetal; 4'-desmethoxypapaveroxine, narcotinoline hemiacetal and narcotinoline comprising:

(a) providing a chimeric nucleic acid sequence comprising in the 5' to 3' direction of transcription as operably linked components:
  (i) one or more nucleic acid sequences encoding one or more of the polypeptides selected from the group of polypeptides consisting of CYP82Y1; CYP82X2; AT1; CYP82X1; OMT; CXE1 and NOS; and
  (ii) one or more nucleic acid sequences capable of controlling expression in a host cell;
(b) introducing the chimeric nucleic acid sequence into a host cell and growing the host cell to produce the polypeptide selected from the group of polypeptides consisting of CYP82Y1; CYP82X2; AT1; CYP82X1; OMT; CXE1 and/or NOS and to produce one or more of noscapine or one of the noscapine synthesis intermediates; and
(c) recovering noscapine or a noscapine synthesis intermediate or noscapine synthesis intermediate derivatives.

In preferred embodiments, the nucleic acid sequences are selected from the nucleic acid sequences set forth herein as one or more of SEQ.ID. NO.1; SEQ.ID. NO.3; SEQ.ID. NO.5; SEQ.ID. NO.7; SEQ.ID. NO.9; and SEQ.ID. NO.11. The hereinbefore mentioned polypeptide or polypeptides are selected in accordance with the specific noscapine synthesis intermediate(s) or noscapine that is desirable to obtain. Thus, by way of non-limiting example, if one wishes to prepare noscapine one may introduce in a host cell capable of producing S—N-methylcanadine, a chimeric nucleic acid sequence into a host cell encoding the polypeptides CYP82Y1; CYP82X2; AT1; CYP82X1; OMT; CXE1 and/or NOS (i.e. a nucleic acid sequence comprising SEQ.ID. NO.1; SEQ.ID. NO.3; SEQ.ID. NO.5; SEQ.ID. NO.7; SEQ.ID. NO.9; and SEQ.ID. NO.11). Further nucleic acid and polypeptides may be obtained from a variety of plant species including, without limitation, plant species belonging to the plant families of Eupteleaceae, Lardizabalaceae, Circaeasteraceae, Menispermaceae, Berberidaceae, Ranunculaceae, and Papaveraceae (including those belonging to the subfamilies of Pteridophylloideae, Papaveroideae and Fumarioideae) and further includes plants belonging to the genus *Argemone*, including *Argemone mexicana* (Mexican Prickly Poppy), plants belonging to the genus *Berberis*, including *Berberis thunbergii* (Japanese Barberry), plants belonging to the genus *Chelidonium*, including *Chelidonium majus* (Greater Celandine), plants belonging to the genus *Cissampelos*, including *Cissampelos mucronate* (Abuta), plants belonging to the genus *Cocculus*, including *Cocculus trilobus* (Korean Moonseed), plants belonging to the genus *Corydalis*, including *Corydalis chelanthifolia* (Ferny Fumewort), *Corydalis cava; Corydalis ochotenis; Corydalis ophiocarpa; Corydalis platycarpa; Corydalis tuberosa* and *Cordyalis bulbosa*, plants belonging to the genus *Eschscholzia*, including *Eschscholzia californica* (California Poppy), plants belonging to the genus *Glaucium*, including *Glaucium flavum* (Yellowhorn Poppy), plants belonging to the genus *Hydrastis*, including *Hydrastis canadensis* (Goldenseal), plants belonging to the genus *Jeffersonia*, including *Jeffersonia diphylla* (Rheumatism Root), plants belonging to the genus *Mahonia*, including *Mahonia aquifolium* (Oregon Grape), plants belonging to the genus *Menispermum*, including *Menispermum canadense* (Canadian Moonseed), plants belonging to the genus *Nandina*, including *Nandina domestica* (Sacred Bamboo), plants belonging to the genus *Nigella*, including *Nigella sativa* (Black Cumin), plants belonging to the genus *Papaver*, including *Papaver armeniacum*, *Papaver bracteatum* (Persian Poppy), *Papaver somniferum*, *Papaver cylindricum*, *Papaver decaisnei*, *Papaver fugax*, *Papaver oreophyllum*, *Papaver orientale*, *Papaver paeonifolium*, *Papaver persicum*, *Papaver pseudo-orientale*, *Papaver rhoeas*, *Papaver rhopalothece*, *Papaver setigerum*, *Papaver tauricolum*, and *Papaver triniaefolium*, plants belonging to the genus *Sanguinaria*, including *Sanguinaria canadensis* (Bloodroot), plants belonging to the genus *Stylophorum*, including *Stylophorum diphyllum* (Celandine Poppy), plants belonging to the genus *Thalictrum*, including *Thalictrum flavum* (Meadow Rue), plants belonging to the genus *Tinospora*, including *Tinospora cordifolia* (Heartleaf Moonseed), plants belonging to the genus *Xanthoriza*, including *Xanthoriza simplicissima* (Yellowroot) and plants belonging to the genus *Romeria* including *Romeria carica*. Further specific nucleic acid sequences and polypeptide sequences that may be used in accordance herewith are set forth in Table L and Table M and in SEQ. ID NO: 1-SEQ. ID. NO: 598.

Further combinations of nucleic acid sequences in order to produce noscapine or noscapine synthesis intermediates or noscapine synthesis intermediate derivatives in accordance herewith may be selected by referring to Tables A-K and any and all of the combinations of nucleic acid sequences encoding the enzymes set forth in Tables A-K are specifically included herein.

In accordance herewith, the nucleic acid sequence encoding CYP82Y1; CYP82X2; AT1; CYP82X1; OMT; CXE1 and/or NOS is linked to a nucleic acid sequence capable of controlling expression of CYP82Y1; CYP82X2; AT1; CYP82X1; OMT; CXE1 and NOS in a host cell. Accordingly, the present disclosure also provides a nucleic acid sequence encoding CYP82Y1; CYP82X2; AT1; CYP82X1; OMT; CXE1 and NOS linked to a promoter capable of controlling expression in a host cell. Nucleic acid sequences capable of controlling expression in host cells that may be used herein include any transcriptional promoter capable of controlling expression of polypeptides in host cells. Generally, promoters obtained from bacterial cells are used when a bacterial host is selected in accordance herewith, while a fungal promoter will be used when a fungal host is selected, a plant promoter will be used when a plant cell is selected, and so on. Further nucleic acid elements capable elements of controlling expression in a host cell include transcriptional terminators, enhancers and the like, all of which may be included in the chimeric nucleic acid sequences of the present disclosure.

In accordance with the present disclosure, the chimeric nucleic acid sequences comprising a promoter capable of controlling expression in host cell linked to a nucleic acid sequence encoding CYP82Y1; CYP82X2; AT1; CYP82X1; OMT; CXE1 and NOS, can be integrated into a recombinant expression vector which ensures good expression in the host cell. Accordingly, the present disclosure includes a recombinant expression vector comprising in the 5' to 3' direction of transcription as operably linked components:
  (i) a nucleic acid sequence capable of controlling expression in a host cell; and
  (ii) a nucleic acid sequence encoding CYP82Y1; CYP82X2; AT1; CYP82X1; OMT; CXE1 and/or NOS.

wherein the expression vector is suitable for expression in a host cell. The term "suitable for expression in a host cell" means that the recombinant expression vector comprises the chimeric nucleic acid sequence of the present disclosure linked to genetic elements required to achieve expression in a host cell. Genetic elements that may be included in the expression vector in this regard include a transcriptional termination region, one or more nucleic acid sequences encoding marker genes, one or more origins of replication and the like. In preferred embodiments, the expression vector further comprises genetic elements required for the integration of the vector or a portion thereof in the host cell's genome, for example if a plant host cell is used the T-DNA left and right border sequences which facilitate the integration into the plant's nuclear genome. Further combinations of nucleic acid sequences in order to produce noscapine or noscapine synthesis intermediates in accordance herewith may be selected by referring to Tables A-K.

Pursuant to the present disclosure the expression vector may further contain a marker gene. Marker genes that may be used in accordance with the present disclosure include all genes that allow the distinction of transformed cells from non-transformed cells, including all selectable and screenable marker genes. A marker gene may be a resistance marker such as an antibiotic resistance marker against, for example, kanamycin or ampicillin. Screenable markers that may be employed to identify transformants through visual inspection include β-glucuronidase (GUS) (U.S. Pat. Nos. 5,268,463 and 5,599,670) and green fluorescent protein (GFP) (Niedz et al., 1995, Plant Cell Rep., 14: 403).

One host cell that particularly conveniently may be used is *Escherichia coli*. The preparation of the *E. coli* vectors may be accomplished using commonly known techniques such as restriction digestion, ligation, gelectrophoresis, DNA sequencing, the Polymerase Chain Reaction (PCR) and other methodologies. A wide variety of cloning vectors is available to perform the necessary steps required to prepare a recombinant expression vector. Among the vectors with a replication system functional in *E. coli*, are vectors such as pBR322, the pUC series of vectors, the M13 mp series of vectors, pBluescript etc. Typically, these cloning vectors contain a marker allowing selection of transformed cells. Nucleic acid sequences may be introduced in these vectors, and the vectors may be introduced in *E. coli* by preparing competent cells, electroporation or using other well known methodologies to a person of skill in the art. *E. coli* may be grown in an appropriate medium, such as Luria-Broth medium and harvested. Recombinant expression vectors may readily be recovered from cells upon harvesting and lysing of the cells. Further, general guidance with respect to the preparation of recombinant vectors and growth of recombinant organisms may be found in, for example: Sambrook et al., Molecular Cloning, a Laboratory Manual, Cold Spring Harbor Laboratory Press, 2001, Third Ed.

Further included in the present disclosure are a host cell wherein the host cell comprised a chimeric nucleic acid sequence comprising in the 5' to 3' direction of transcription as operably linked components one or more nucleic acid sequences encoding one or more of the polypeptides selected from the group of polypeptides consisting of CYP82Y1; CYP82X2; AT1; CYP82X1; OMT; CXE1 and NOS. As hereinbefore mentioned the host cell is preferably a host cell capable of producing at least one of the noscapine synthesis intermediates of the present disclosure, but is unable to produce noscapine or one or more of noscapine or the other noscapine synthesis intermediates of the present disclosure, but for the introduction of the chimeric nucleic acid sequences of the present disclosure. Combinations of nucleic acid sequences in order to produce noscapine or noscapine synthesis intermediates or noscapine synthesis intermediate derivatives in accordance herewith may be selected by referring to Tables A-K and host cells comprising any and all of the combinations of nucleic acid sequences encoding the polypeptides set forth in Tables A-K are specifically included herein.

As hereinbefore mentioned, in other embodiments, the living cells naturally produce one or more of the noscapine synthesis intermediates or noscapine or noscapine synthesis intermediate derivatives of the present disclosure, however the living cells are modulated in such a manner that the levels of one or more of the noscapine synthesis intermediates or noscapine synthesis intermediate derivatives or noscapine produced in the cells is modulated, without heterologous introduction of any of the aforementioned enzymes in such living cells. Such modulations may be achieved by a variety of modification techniques, including, but not limited to, the modulation of one or more of the enzymatic activities of CYP82Y1; CYP82X2; AT1; CYP82X1; OMT; CXE1 and NOS, for example by modulating the native nucleic acid sequences encoding CYP82Y1; CYP82X2; AT1; CYP82X1; OMT; CXE1 and/or NOS, for example by gene silencing methodologies, such as antisense methodologies; or by the use of modification techniques resulting in modulation of activity of the enzymes using for example site directed mutagenesis, targeted mutagenesis, random mutagenesis, virus-induced gene silencing, the addition of organic solvents, gene shuffling or a combination of these and other techniques known to those of skill in the art, each methodology designed to alter the activity of the enzymes of CYP82Y1; CYP82X2; AT1; CYP82X1; OMT; CXE1 and NOS, in such a manner that the accumulation of one or more of noscapine or the noscapine intermediates in the living cells increases. Thus the present disclosure further includes embodiments which involve modulating living cells by reducing the production of NOS in order to produce narcotine hemiacetal and/or papaveroxine; modulating living cells by reducing the production of CXE1 in order to produce 3-O-acetyl-papaveroxine; modulating living cells by reducing the production of OMT in order to produce 4'-O-desmethoxy-3-O-acetyl-papaveroxine and/or 1,8-dihydroxy-13-O-acetyl-N-methylcanadine; modulating living cells by reducing the production of CYP82X1 in order to produce 1-hydroxy-13-O-acetyl-N-methylcanadine; modulating living cells by reducing the production of AT1 in order to produce 1,13-dihydroxy-N-methylcanadine; modulating living cells by reducing the production of CYP82X2 in order to produce 1-hydroxy-N-methylcanadine; and modulating living cells by reducing the production of CYP82Y1 in order to produce (S)—N-methylcanadine. Thus it will be clear that in accordance with the foregoing embodiments, noscapine synthesis intermediates may be produced by inhibiting an enzyme that converts the desired noscapine synthesis intermediate and providing the noscapine intermediate immediately upstream (as depicted in FIG. 1) of the desired noscapine synthesis intermediate under conditions that permit the production of the desired noscapine synthesis intermediate from the immediate upstream component. Thus, strictly by way of example, one may select a plant comprising the entire synthesis pathway depicted in FIG. 1 (*Papaver somniferum* for example), and inhibit CXE1 in such plant, thereby providing 4'-O-desmethoxy-3-O-acetyl under conditions that permit the production of papaveroxine, 3-O-acetyl-papaveroxine therefrom; or, and again, strictly by way of example, one may select a plant comprising the entire synthesis pathway depicted in FIG. 1 (*Papaver somniferum* for example), and inhibit AT1 in such plant, thereby providing 1-hydroxy-methylcanadine under conditions that permit the production of 1,13-dihydroxy-methylcanadine therefrom.

Provided herein is further a method for preparing noscapine and one or more of the noscapine synthesis intermediates or noscapine precursors selected from the group of noscapine synthesis intermediates and noscapine precursors consisting of: (S)—N-methylcanadine; 1-hydroxy-N-methylcanadine; 1,13-dihydroxy-N-methylcanadine; 1-hydroxy-O-acetyl-N-methylcanadine; 1,8-dihydroxy-13-O-acetyl-N-methylcanadine; 4'-O-desmethoxy-3-O-acetyl-papaveroxine; 3-O-acetyl-papaveroxine; papaveroxine; and narcotine hemiacetal comprising:

(a) providing a chimeric nucleic acid sequence comprising (i) one or more nucleic acid sequences complementary all or a portion of the mRNA synthesized by the nucleic acid sequence encoding the polypeptides selected from the group of polypeptides consisting of CYP82Y1; CYP82X2; AT1; CYP82X1; OMT; CXE1 and NOS; and (ii) one or more elements capable of controlling transcription of the complementary nucleic acid sequence, wherein the chimeric nucleic acid sequence is capable of producing an antisense RNA complementary all or a portion of the mRNA of the nucleic acid sequence encoding the polypeptides selected from the group of polypeptides consisting of CYP82Y1; CYP82X2; AT1; CYP82X1; OMT; CXE1 and NOS;

(b) introducing the chimeric nucleic acid sequence into a host cell;

(c) growing the host cell to produce the antisense RNA and inhibit synthesis of the polypeptide selected from the group of polypeptides consisting of CYP82Y1; CYP82X2; AT1; CYP82X1; OMT; CXE1 and/or NOS, and to produce one or more of noscapine; noscapine synthesis intermediate; or a noscapine precursor selected from the group of noscapine synthesis intermediates consisting of: (S)—N-methylcanadine; 1-hydroxy-N-methylcanadine; 1,13-dihydroxy-N-methylcanadine; 1-hydroxy-O-acetyl-N-methylcanadine; 1,8-dihydroxy-13-O-acetyl-N-methylcanadine; 4'-O-desmethoxy-3-O-acetyl-papaveroxine; 3-O-acetyl-papaveroxine; papaveroxine; and narcotine hemiacetal; and (d) recovering noscapine; noscapine synthesis intermediate or noscapine precursor selected from the group of noscapine synthesis intermediates and noscapine precursors consisting of (S)—N-methylcanadine; 1-hydroxy-N-methylcanadine; 1,13-dihydroxy-N-methylcanadine; 1-hydroxy-O-acetyl-N-methylcanadine; 1,8-dihydroxy-13-O-acetyl-N-methylcanadine; 4'-O-desmethoxy-3-O-acetyl-papaveroxine; 3-O-acetyl-papaveroxine; papaveroxine; and narcotine hemiacetal.

Compositions Comprising Noscapine Synthesis Intermediates and Noscapine Intermediate Synthesis Derivatives In accordance with present disclosure, methods are provided to make various novel noscapine synthesis intermediates and noscapine synthesis intermediate derivatives. Accordingly, further included in the present disclosure are substantially pure or isolated forms of such noscapine intermediates and noscapine synthesis intermediate derivatives. Included in the present disclosure are substantially pure or isolated 1-hydroxy-N-methylcanadine having the chemical formula set forth in FIG. 2B; substantially pure or isolated 1,13-dihydroxy-N-methylcanadine having the chemical formula set forth in FIG. 2C; substantially pure or isolated 1-hydroxy-13-O-acetyl-N-methylcanadine having the chemical formula set forth in FIG. 2D; substantially pure or isolated 1,8-dihydroxy-13-O-acetyl-N-methylcanadine having the chemical formula set forth in FIG. 2E; a substantially pure or isolated 4'-O-desmethoxy-3-O-acetyl-papaveroxine having the chemical formula set forth in FIG. 2F; a substantially pure or isolated 4'-desmethoxypapaveroxine having the chemical formula set forth in FIG. 23A; a substantially pure or isolated narcotoline hemiacetal having the chemical formula set forth in FIG. 23B; and a substantially pure or isolated narcotoline having the chemical formula set forth in FIG. 23C Use of Noscapine. Noscapine Synthesis Intermediates and Noscapine Synthesis Intermediate Derivatives Noscapine obtained in accordance with the present disclosure may be formulated for use as a pharmaceutical drug, therapeutic agent or medicinal agent. Thus the present disclosure further includes a pharmaceutical composition comprising noscapine prepared in accordance with the methods of the present disclosure. Pharmaceutical drug preparations comprising noscapine in accordance with the present disclosure preferably further comprise vehicles, excipients and auxiliary substances, such as wetting or emulsifying agents, pH buffering substances and the like. These vehicles, excipients and auxiliary substances are generally pharmaceutical agents that may be administered without undue toxicity. Pharmaceutically acceptable excipients include, but are not limited to, liquids such as water, saline, polyethyleneglycol, hyaluronic acid, glycerol and ethanol. Pharmaceutically acceptable salts can also be included therein, for example, mineral acid salts such as hydrochlorides, phosphates, sulfates, and the like; and the salts of organic acids such as acetates, propionates, benzoates, and the like. It is also preferred, although not required, that the preparation will contain a pharmaceutically acceptable excipient that serves as a stabilizer. Examples of suitable carriers that also act as stabilizers for peptides include, without limitation, pharmaceutical grades of dextrose, sucrose, lactose, sorbitol, inositol, dextran, and the like. Other suitable carriers include, again without limitation, starch, cellulose, sodium or calcium phosphates, citric acid, glycine, polyethylene glycols (PEGs), and combinations thereof. The pharmaceutical composition may be formulated for oral and intravenous administration and other routes of administration as desired. Dosing may vary, but it is expected that ranges of noscapine between 66 mg (intravenous) and 150 mg (oral) will be tolerated. Dosing may be optimized using routine experimentation. The pharmaceutical composition comprising noscapine may be used as an anti-mitotic and anti-tumor agent, and may further be used to treat or ameliorate cancer, including, but not limiting to, lymphoma, breast cancer, melanoma, ovarian carcinoma, glioblastoma, colon cancer, human non-small cell lung cancer, in a patient having been diagnosed with any of the foregoing conditions. The pharmaceutical composition may further be used to treat or ameliorate stroke, as well as an antitussive drug and an anxiolytic drug.

In further embodiments, the present disclosure provides methods for treating a patient with a pharmaceutical composition comprising noscapine prepared in accordance with the present disclosure. Accordingly, the present disclosure further provides a method for treating a patient with noscapine prepared according to the methods of the present disclosure, said method comprising administering to the patient a composition comprising noscapine, wherein noscapine is administered in an amount sufficient to ameliorate a medical condition in the patient. In preferred embodiments the medical condition is selected from the group of medical conditions consisting of lymphoma, breast cancer, melanoma, ovarian carcinoma, glioblastoma, colon cancer, human non-small cell lung cancer, stroke, anxiety, and coughing.

The noscapine synthesis intermediates provided herein are useful as agents to manufacture noscapine and noscapine derivatives and noscapine synthesis intermediate derivatives. Noscapine synthesis from the noscapine synthesis intermediates herein provided may conveniently be performed in accordance with the methods herein disclosed. It will be apparent however to those of skill in the art that the noscapine synthesis intermediates herein provided may equally be suitable as compositions to manufacture noscapine using other synthesis methodologies, including chemical synthesis methodologies.

EXAMPLES

Hereinafter are provided examples of specific embodiments for performing the methods of the present disclosure, as well as embodiments representing the compositions of the present disclosure. The examples are provided for illustrative purposes only, and are not intended to limit the scope of the present disclosure in any way.

Example 1

Isolation of Nucleic Acid Sequence Encoding CYP82Y1

The opium poppy chemotypes Bea's Choice and Veronica (Desgagné-Penix et al. 2010, BMC Plant Biol. 10: 252) were cultivated at 20/18° C. (light/dark) in a growth chamber (Conviron, Winnipeg, Canada) with a photoperiod of 16 h and a combination of fluorescent and incandescent lighting. Total RNA and alkaloid extractions from the latex of eight opium poppy chemotypes were subjected to transcript and metabolite profiling, respectively, as described previously (Desgagné-Penix et al. 2010, BMC Plant Biol. 10: 252; Dang and Facchini 2012, Plant Physiol. 159-618-631). CYP82Y1 was identified among genes differentially expressed in noscapine-free (Deborah, Przemko, 40 and T) and noscapine-producing (Natasha, Marianne, Roxanne, and Veronica) chemotypes of opium poppy (Desgagné-Penix et al. 2010, BMC Plant Biol. 10: 252). The full-length coding region of CYP82Y1, was assembled in silico by searching each database using the tBLASTn algorithm, and is provided herein as SEQ.ID NO:1. The deduced amino acid sequence is provided herein as SEQ.ID NO:2 Relative transcript abundance was determined as the number of reads corresponding to each selected candidate compared with the total number of reads in each database (Dang and Facchini 2012, Plant Physiol. 159-618-631).

Example 2

Isolation of Nucleic Acid Sequence Encoding NOS

Opium poppy (*Papaver somniferum*) chemotypes Bea's Choice and Roxanne were grown as described previously (Dang et al. 2012, Methods Enzymol. 515: 231-266). Narcotoline hemiacetal and codeinone were purchased from Toronto Research Chemicals (Toronto, Canada). Salutaridine was isolated by methanol extraction from the latex of plants subjected to virus-induced silencing of the gene encoding salutaridine reductase (SalR) (Wijekoon and Facchini, 2012, Plant J. 69: 1052-1063) and purified on a Silica Gel 60 $F_{254}$ TLC plate (Merck, Whitehouse Station, N.J.), which was subsequently developed in a solvent system of toluene:acetone:ammonia ethanol [45:45:10 (v/v)]. The source of all other alkaloids has been described previously (Dang and Facchini, 2012, Plant Physiol. 159: 618-631). An integrated transcript and metabolite profiling strategy was used to identify NOS. Previously, we established a deep transcriptome database using 454 pyrosequencing for eight opium poppy chemotypes displaying different alkaloid profiles (Desgagné-Penix et al. 2012, Plant J. 72: 331-344). Using these resources, differential expression analysis performed using two poppy chemotypes: Deborah with non-detectable levels of noscapine and Marianne with substantial accumulation of noscapine and narcotoline, Candidate transcripts were selected that were either exclusive to or showed higher abundance in Marianne. Dehydrogenation of a hydroxyl group is normally catalyzed by a bi-functional dehydrogenase/reductase; thus, the search term 'dehydrogenase/reductase' was used to query the isolated sequence pool of 683 contigs and 22 candidate sequences annotated with various dehydrogenase/reductase functions were returned. Using these candidate sequences to query the transcriptome databases of seven opium poppy cultivars, including three noscapine-free chemotypes (i.e. T, 40, and Deborah) and four noscapine-abundant chemotypes (i.e. Marianne, Natasha, Roxanne, and Veronica), the relative transcript abundance (defined as the number of reads per contig divided by the total number of 454 reads used to generate contigs assembling in each database) of the individual 22 candidates was obtained and compared across different cultivars. Out of 22 candidates, one (designated CL1327Contig1) was not present in the transcriptome databases of the three noscapine-free chemotypes and showed substantial transcript abundance in all four noscapine-abundant chemotypes. No other candidate showed a consistent correlation between the occurrence of transcripts and noscapine across all seven cultivars. Thus, CL1327Contig1 was considered as the prime candidate for the dehydrogenase/reductase catalyzing the conversion of narcotinhemiacetal to noscapine. The CL1327Contig1 sequence was 1207 base pairs (bp) in length and contained only a partial open reading frame. Using this sequence to query the transcriptome databases of the three noscapine-abundant cultivars, the full-length gene was obtained, which contained a coding region of 1044 bp encoding 348 amino acids. The nucleic acid sequence is provided herein as SEQ.ID NO:13. The deduced amino acid sequence is provided herein as SEQ.ID NO:14. Sequence structure analysis (Conserved Domain Search, NCBI) indicated that the enzyme contains conserved domains including an N-terminal glycine-rich motif $TG^{28}G^{29}AG^{31}YLA$ predicted to be involved in NAD(P)(H) binding and an catalytic active site $Y^{186}VVSK^{190}$ found in the 'extended' short-chain dehydrogenase/reductase (SDR) family. A BLAST search against the NCBI reference proteins (refseq_protein) revealed that the enzyme shared 51% amino acid sequence identity with dihydroflavonol-4-reductases, which belong to the extended SDR family, from a number of plant species including mouse-ear cress (*Arabidopsis thaliana*), castor bean (*Ricinus communis*), and barrel clover (*Medicago truncatula*). Three known dehydrogenase/reductase enzymes are involved in BIA metabolism: the SDRs salutaridine reductase (SalR) (Ziegler et al., 2006, Plant J. 48: 177-192) and sanguinarine reductase (SanR) (Vogel et al., 2010, J. Biol. Chem. 285: 18397-18406) and the aldo-keto reductase (AKR) codeinone reductase (COR) (Unterlinner et al., 1999, Plant J. 18: 465-475). Phylogenetic analysis of NOS, SalR, SanR, COR, and corresponding homologs from different plant species revealed low sequence identity among the SDRs suggesting a divergent function for NOS compared with other enzymes.

Example 3

Expression of CYP82Y1 in Yeast

The full-length coding region of CYP82Y1 was amplified from cDNA derived from total stem RNA of the Bea's Choice chemotype using Takara Ex Taq DNA polymerase (Fisher Scientific, Ottawa, Canada) and the following primer set: 5'-ATTAGCGGCCGCACCATGGCGTATTTGATGAT-CAA-3' (SEQ ID NO: 599) and 5'-CATAACTAGTG-CATCTAGTGT GCGTGGGGTGA-3' (SEQ ID NO: 600). A-tailing with Taq DNA polymerase, the amplicon was cloned into pGEM-T (Promega, Madison, Wis.) and propagated in E. coli strain XL1BlueMRF. For heterologous over-expression of Flag-tagged CYP82Y1, the plasmid was ligated into the NotI and SpeI restriction site of the dual plasmid pESC-leu2d::CPR (Ro et al. 2008, BMC Biotech 8: 83; Beaudoin and Facchini 2013, Biochem. Biophys. Res. Commun. 431: 597-603) yielding pESC-Leu2d::CYP82Y1/CPR. Yeast harboring pESC-leu2d::MSH/CPR, which produces cytochrome P450 reductase (CPR) and N-methylstylopine 14-hydroxylase (MSH), denoted in FIG. 3 "CPR/MSH") (Beaudoin and Facchini 2013, Biochem. Biophys. Res. Commun. 431: 597-603) was used as a positive control to assess the expression of CYP82Y1. Yeast harboring pESC-leu2d::CPR (denoted in FIG. 3 "CPR") was used as the negative control.

The protease-deficient Saccharomyces cerevisiae strain YPL 154C:Pep4 was transformed with pESC-Leu2d::CYP82Y1/CPR. The transformed yeast was used to inoculate 2 mL of synthetic complete (SC) medium lacking leucine (Leu) (SC-Leu), but containing 2% (w/v) glucose, and cultured overnight on a gyratory shaker at 250 rpm and at 30° C. This initial culture was then diluted 100-fold in SC-Leu medium supplemented with 2% (w/v) glucose and cultured for 16 h. Yeast was harvested and transferred to fresh SC-Leu containing 2% (w/v) galactose for 24 h to induce expression of recombinant genes. For in vitro assays, yeast was transferred to fresh SC-Leu containing 2% (w/v) galactose, 50 µM (S)—N-methylcanadine, and 100 mM HEPES/NaOH (pH 7.5). After cultivation for 24 h, yeast cells were removed and the culture medium was extracted twice with methanol, which was reduced to dryness and subjected to LC-MS/MS analysis. Yeast strain YPL 154C:Pep4 harboring pESC-Leu2d::CPR was used as the negative control.

Figure 3:
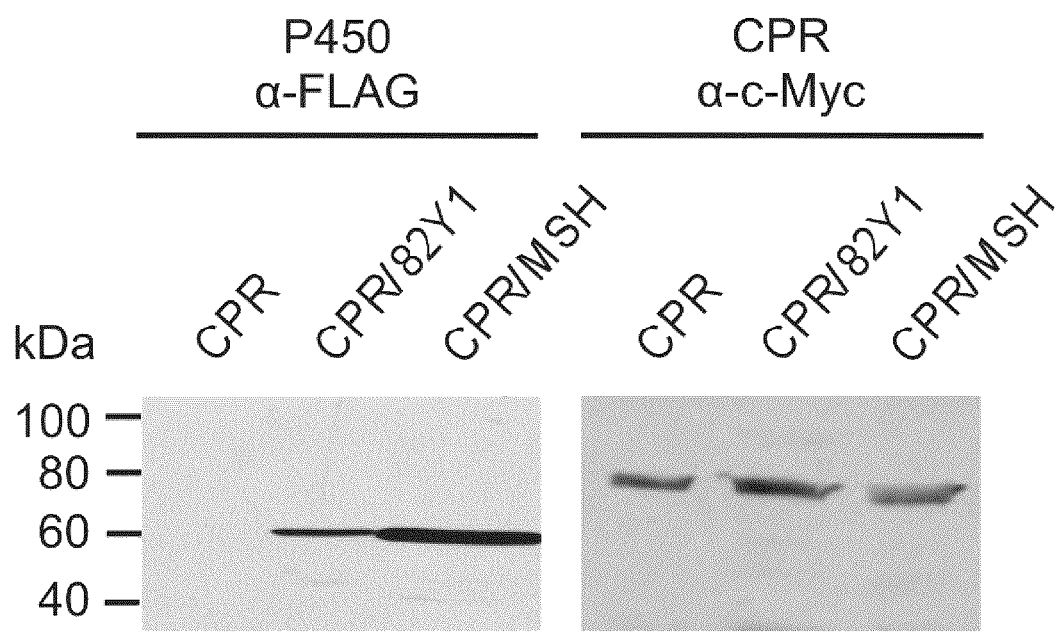
FIG. 3 depicts a western blot showing heterologous expression of CYP82Y1 in yeast. As further detailed in Example 3, Saccharomyces cerevisiae harboring pESC-leu2d::CPR (CPR), pESC-leu2d::CYP82Y1/CPR (CPR/82Y1), or pESC-leu2d::MSH/CPR (CPR/MSH) were induced on galactose, and CPR, CYP82Y1 or MSH (CYP82N4) recombinant proteins were detected using α-FLAG (CYP) and α-c-Myc (CPR) antibodies. Each lane contained 2 μg of total microsomal proteins.

Yeast microsomes were prepared as described previously (Pompon et al. 1996, Methods Enzym. 272: 51-64). Yeast cells were lysed for 5 min using a micro-beadbeater and 500 µm diameter glass beads. Recombinant enzymes were detected by immunoblot analysis. Briefly, microsomal proteins were fractionated on a 10% (w/v) gel using SDS-PAGE and transferred to a nitrocellulose membrane. The membrane was blocked with 5% (w/v) skim milk in TBST buffer [25 mM Tris-HCl, pH 7.5, 150 mM NaCl and 0.05% (v/v) Tween 20] for 1 h, and subsequently incubated with α-FLAG M2 and α-c-Myc antibodies (Bioshop) used at a dilution of 1:5,000 to detect CYP and CPR proteins, respectively. After incubation with primary antibodies, membranes were washed three times with TBST and incubated with goat anti-mouse secondary antibody (Sigma-Aldrich) used at a dilution of 1:10,000. The membranes were again washed three times in TBST and bound secondary antibodies were detected using SuperSignal West Pico Chemiluminescent Substrate. Heterologous expression and detection of CYP82Y1 in yeast microsomes is shown in FIG. 3.

Example 4

Cloning, Expression and Isolation of NOS in E. coli

Figure 4:
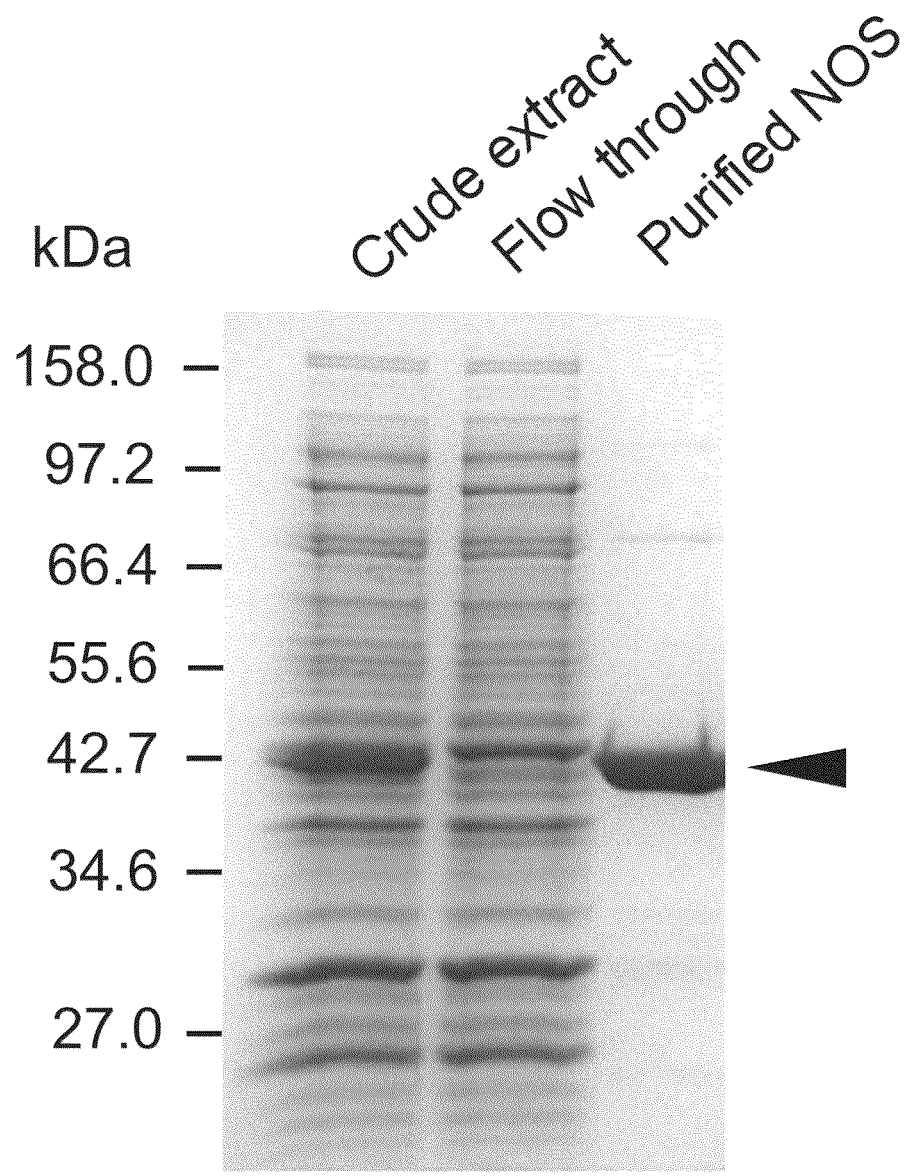
FIG. 4 depicts a polyacrylamide gel showing the heterologous expression of NOS in Escherichia coli and purification of NOS from E. coli.

The full-length cDNA sequence of CL1327Contig1 (see: Example 2) was cloned into vector pRSETA in-frame with an N-terminal His-tag and expressed in E. coli as follows. The NOS coding region was amplified from opium poppy stem cDNA using the following primer set: 5'-GACT-GAGCTCATGCATGGACAGAAAAATA TATCAGA-GAG-3' (SEQ ID NO: 601) and 5'-GACTGGTACCTAC TAAAGGAAACCCTTCTCTTTGGCACATCG-3' (SEQ ID NO: 602). The NOS cDNA was cloned into the expression vector pRSETA (Invitrogen) at the SacI and KpnI restriction sites in frame with an N-terminal His-tag sequence. The expression construct was transformed into Escherichia coli strain Rosetta (DE3) pLysS (EMD Chemicals, Darmstadt, Germany). Expression of the recombinant gene was induced overnight with 1 mM isopropyl β-D-thiogalactoside (IPTG) at room temperature. Cells were harvested by centrifugation and sonicated in a buffer containing 50 mM sodium phosphate, pH 7.0, 300 mM NaCl, and 10 mM β-mercaptoethanol. After centrifugation at 20,000 g for 10 min, the supernatant was loaded onto Talon cobalt affinity resin (Clontech, Mountain View, Calif.). Purification was performed according to the manufacturer's instruction. The purified, recombinant protein was desalted using an Amicon centrifugal filter –30K (Millipore, Billerica, Mass.) and stored in a buffer containing 50 mM Tris-HCl, pH 8.0, 1 mM EDTA, 1 mM β-mercaptoethanol, and 10% (v/v) glycerol. Protein concentration was determined by the Bradford assay (Bio-Rad, Hercules, Calif.) using bovine serum albumin as the standard. The recombinant protein was purified to homogeneity and showed a molecular weight of 42 kDa, as further detailed in FIG. 4.

Example 5

In Vitro Conversion of (S)—N-Methylcanadine to 1-Hydroxy-N-Methylcanadine

Figure 5:
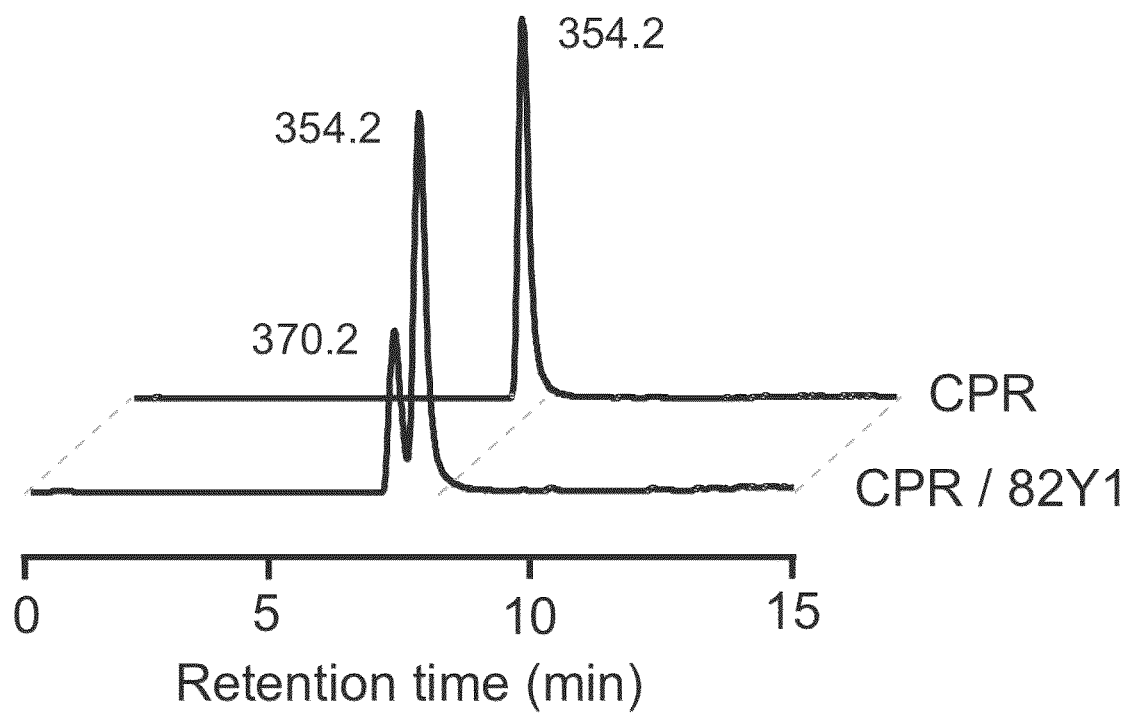
FIG. 5 depicts an LC-MS/MS ion chromatogram showing the in vitro conversion of (S)—N-methylcanadine to 1-hydroxy-N-methylcanadine by CYP82Y1. Shown is the formation of a reaction product with m/z 370, which is absent in the control.

In vitro enzyme assays were performed using yeast microsomal fractions prepared as described in Example 3. (S)—N-methylcanadine to 1-hydroxy-N-methylcanadine was exogenously added to the microsomal fractions as a substrate yielding 1-hydroxy-N-methylcanadine. Enzyme assays were performed in 200 µL of 100 mM HEPES-NaOH, pH 7.5, containing 5 mg of total microsomal proteins, 50 µM (S)—N-methylcanadine and 500 µM NADPH. The reaction was conducted on a gyratory shaker with gentle agitation (60 rpm) at 30° C. for 30 min. The reaction was stopped by the addition of 800 µL methanol. Control assays were performed with microsomal protein extracts from yeast harboring pESC-leu2th:CPR. Results were evaluated using LC-MS/MS. Enzyme assay samples were diluted 1:10, with solvent A [10 mM ammonium acetate:acetonitrile (95:5)] and analyzed using a 6410 Triple Quadruple LC-MS/MS (Agilent Technologies, Santa Clara, Calif.). Liquid chromatography was carried out using a Poroshell 120 SB C18 column (2.1×50 mm, 2.7 µm particle size; Agilent Technologies) at a flow rate of 0.7 mL min$^{-1}$. The column was equilibrated in solvent A and the following elution conditions were used: 0 to 6 min 60% solvent B (acetonitrile), 6 to 7 min ramp to 99% solvent B, 7 to 9 min isocratic at 99% solvent B, and 9 to 13 min ramp to 0% solvent B. Samples were injected into the mass analyzer via an electrospray ionization (ESI) probe inlet. Ions were generated and focused using the following parameters: capillary voltage, 4000 kV; gas flow, 9 L min$^{-1}$, fragmentor voltage, 100V; nebulizer pressure, 40 psi; gas temperature, 330 ▢ C. Mass spectrometry data were acquired in positive ion mode in the range of m/z 200-700. LC-MS/MS ion-chromatograms showing in vitro catalytic activity of CYP82Y1 compared with a negative control is shown in FIG. 5. Additionally, a variety of alkaloids belonging to several different benzoisoquinoline alkaloid subgroups (1-benzylisoquinoline, morphinan, protoberberine, pavine, aporphine, benzophenanthridine, protopine, phthalideisoquinoline, and bisbenzylisoquinoline) were tested as potential CYP82Y1 substrates. None of these substrates were converted by CYP82Y1.

Example 6

Structure of 1-Hydroxy-N-Methylcanadine

Yeast microsomes were prepared from a yeast strain expressing CYP82Y1, as described in Examples 2 and 3 and enzyme catalysis was conducted in vitro as described in Example 5. The enzymatic reaction product was identified as follows.

High-resolution MS$^n$ experiments were performed using an LTQ-Orbitrap XL equipped with a syringe pump and an Accela HPLC system (ThermoFisher Scientific). Alkaloids (1 μg mL$^{-1}$) were introduced continuously with a syringe pump (5 μK min$^{-1}$) into the HPLC flow at a rate of 500 mL min$^{-1}$ using acetonitrile and positive ions were generated by heated ESI with the following parameters: heater, 400° C.; sheath gas, 60 au; auxiliary gas, 20 au; spray voltage, 3 kV. Ion interface settings were 380° C. and 38 V (capillary) and 85 V (tube lens). MS$^n$ experiments were performed by conducting CID on target ions isolated in the linear ion trap followed by high-resolution (60,000 FWHM) mass analysis of the resulting fragment ions in the Orbitrap XL. Full-scan data was collected in centroid mode over mass ranges extending from the lowest permissible value up to 10 atomic mass units (amu) beyond the parent ion. Detection methods consisted of 3 scan events of approximately 1 s each with a total run time of 10 min. External and internal instrument calibration ensured an error of <2 ppm.

Collision-induced dissociation (CID) mass spectra were recorded using collision energy of −25.0 eV applied in quadrupole 2 and an argon collision gas pressure of 1.8× 10−3 torr. MS2 fragments were analyzed in quadrupole 3 by scanning from m/z 40 to m/z 2 greater than that of the precursor ion. Compounds were identified based on retention times and CID spectra compared with authentic standards, and alkaloid content was calculated as ng alkaloid μg-1 dry weight of latex based on standard quantification curves.

Figure 6:
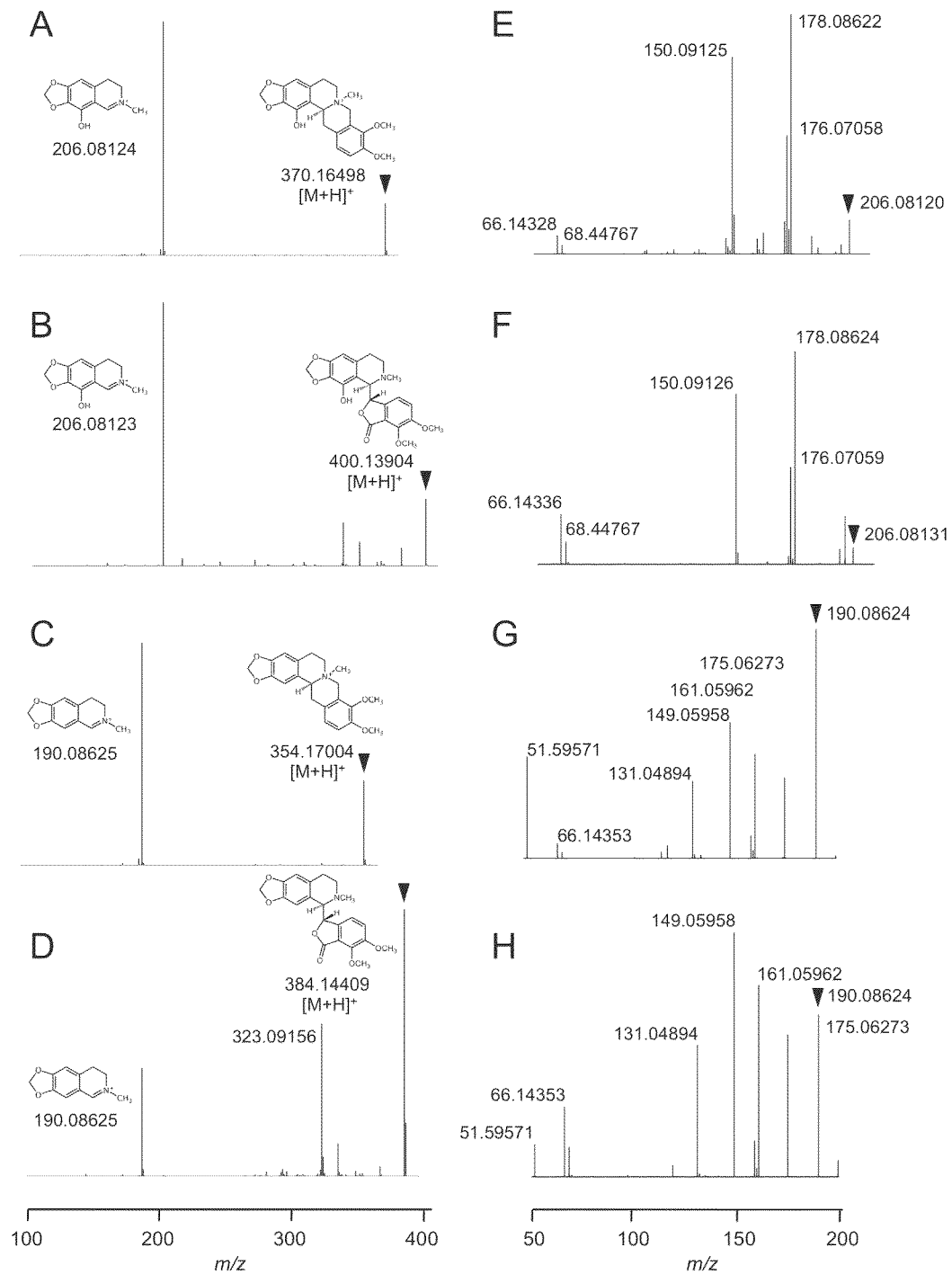
FIG. 6 depicts certain Collision-induced Dissociation (CID) spectra of 1-hydroxy-N-methylcanadine and related compounds. Shown are the CID spectrum of 1-hydroxy-N-methylcanadine (FIG. 6A); narcotoline (FIG. 6B); (S)—N-methylcanadine (FIG. 6C); hydrastine (FIG. 6 D); fragmentation in $MS^3$ of m/z 206 daughter ions of 1-hydroxy-N-methylcanadine (FIG. 6E); narcotinoline (FIG. 6F) and fragmentation in $MS^3$ of m/z 190 daughter ions of (S)—N-methylcanadine (FIG. 6G); and hydrastine (FIG. 6F).

Since authentic standards were not available and the compound quantities were insufficient to perform NMR, mass fragmentation data for the enzymatic reaction product (1-hydroxy-N-methylcanadine) and the substrate (N-methylcanadine) were compared to authentic standards of the phthalideisoquinoline alkaloids narcotoline and hydrastine. Narcotoline and 1-hydroxyl-N-methylcanadine both possess a 1-hydroxyl group, whereas hydrastine and N-methylcanadine are not hydroxylated at the C-1 position. CID of both phthalideisoquinoline and protoberberine alkaloids generally yielded a principal isoquinoline fragment (Le, P. M. et al., Anal. Bioanal. Chem. 405: 4487-4498), which allowed MS$^3$ fragmentation analysis of equivalent MS$^2$ daughter ions. Narcotoline and the 1-hydroxy-N-methylcanadine reaction product yielded isoquinoline fragments at 206.08124 and 206.08123 m/z, respectively, corresponding to an elemental formula of $C_{11}H_{12}O_3N$ and indicating that hydroxylation of N-methylcanadine had occurred at position C-1 (FIGS. 6 A and B). In contrast, MS$^2$ of hydrastine and the N-methylcanadine substrate both yielded fragments at 190.08625 m/z corresponding to an elemental formula of $C_{11}H_{12}O_2N$, which is consistent with an isoquinoline moiety lacking a 1-hydroxyl group (FIGS. 6 C and D). To confirm that 1-hydroxylation of N-methylcanadine had occurred, CID analysis of all isoquinoline ions was performed. MS$^3$ revealed nearly identical spectra for both 1-hydroxylated isoquinoline moieties of hydroxyl-N-methylcanadine and narcotoline (FIGS. 6 E and F) and similarly identical spectra for both non-hydroxylated isoquinoline ions (FIGS. 6 G and H) of N-methylcanadine and hydrastine. Since the product derived from N-methylstylopine also produced similar fragmentation pattern with in triple quadrupole MS/MS, we conclude that a similar hydroxylation event has happened to N-methylstylopine (m/z 338.2) to give rise to 1-hydroxy-N-methylstylopine. The foregoing establishes that the reaction product of N-methylcanadine is 1-hydroxy-N-methylcanadine.

Example 7

In Vitro Conversion of Narcotine Hemiacetal to Noscapine

Figure 7:
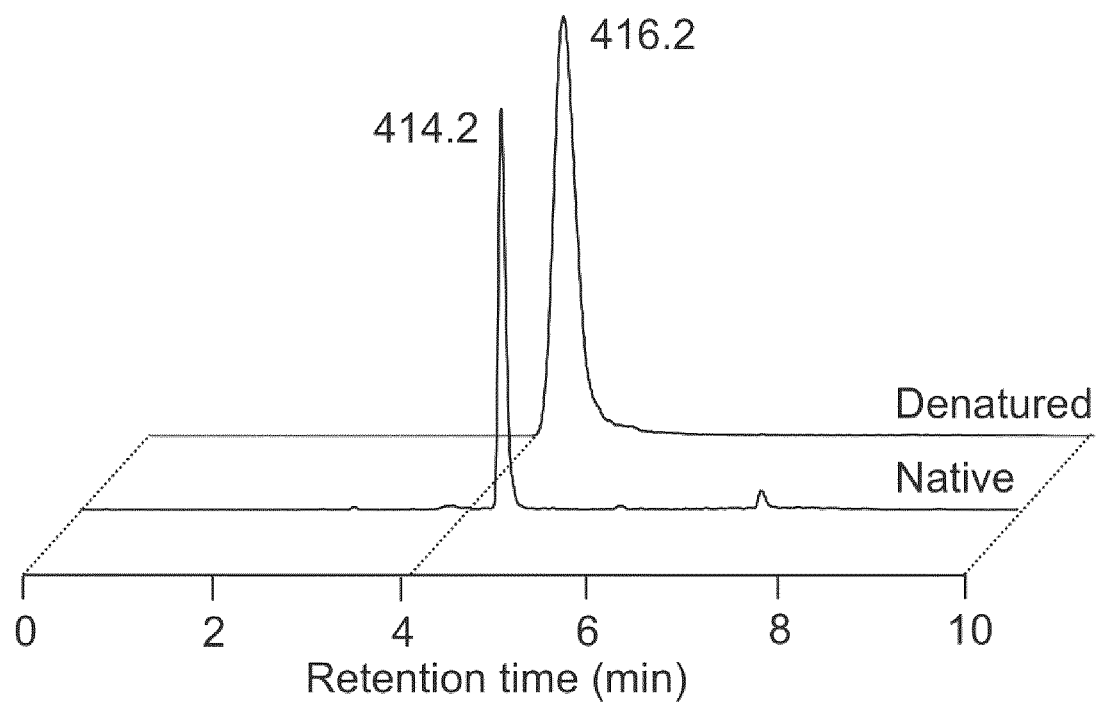
FIG. 7 depicts a LC-MS/MS ion chromatogram showing the in vitro conversion of narcotine hemiacetal to noscapine by NOS.
Figure 8:
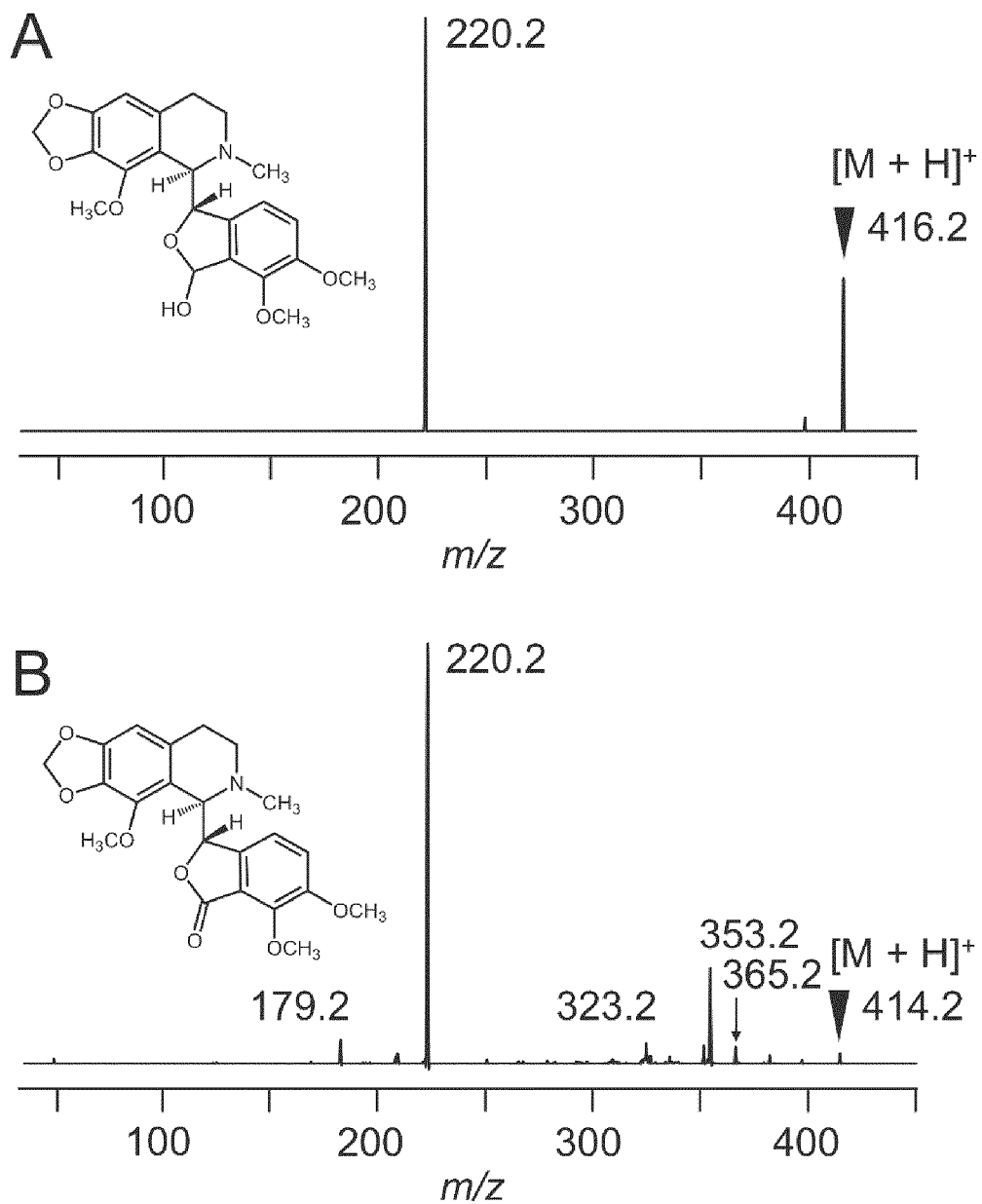
FIG. 8 depicts certain Collision-induced Dissociation (CID) spectra of narcotine hemiacetal (FIG. 8A) and noscapine (FIG. 8B).

The purified recombinant NOS enzyme (see: Example 4) was assayed using either narcotine hemiacetal as the substrate (in the presence of either NAD$^+$ or NADP$^+$ as cofactor) for dehydrogenase activity, or with noscapine as the substrate (in the presence of NADH or NADPH as the cofactor) for reductase activity. LC-MS/MS was used to identify and quantify product formation (FIG. 7). When the recombinant protein was assayed with narcotine hemiacetal (m/z 416), the formation of a new compound of m/z 414 was detected. ESI[+]-CID on the reaction product at m/z 414 produced a spectrum consistent with the corresponding spectrum of authentic noscapine (FIG. 8). Thus, the NOS recombinant enzyme was able to oxidize the hydroxyl group on the hemiacetal ring of narcotine hemiacetal to a ketogroup and, thus, form the lactone ring of noscapine. LC-MS/MS and CID spec Initial enzyme assays suggested that NOS accepted both NAD$^+$ and NADP$^+$ as cofactors for the conversion of narcotine hemiacetal to noscapine. Further kinetic analysis for NAD$^+$ showed $K_m$ and kcat/Km values of 33.1 μM and 16,240 M$^{-1}$ s$^{-1}$, respectively. The $K_m$ value for NADP$^+$ was substantially higher than that of NAD$^+$ at 1,249 μM and the corresponding kcat/Km value for NADP$^+$ was much lower than that for NAD$^+$ at 1,380 M$^{-1}$ s$^{-1}$ indicating a greater cofactor affinity and higher catalytic efficiency for NOS in the presence of NAD$^+$ as opposed to NADP$^+$. In the presence of NAD$^+$, the affinity of NOS for the alkaloid substrate narcotine hemiacetal and the corresponding catalytic efficiency were also significantly higher compared with the use of NADP$^+$ as the cofactor, which were reflected by the lower $K_m$ and higher corresponding kcat/Km values for narcotine hemiacetal with NAD$^+$ as a cofactor. In addition to narcotine hemiacetal and noscapine, NOS was also assayed with several other BIAs that could potentially serve as substrates for dehydrogenase/reductase reactions. Morphine, codeine, codeinone, salutaridine and stylopine (Bagel et al. 2012, J. Biol. Chem. 287: 42927-42983) were tested as possible substrates in corresponding assays, but none were accepted by NOS.

Example 8

In Vivo Production of 1-Hydroxy-N-Methylcanadine in Yeast

Figure 9:
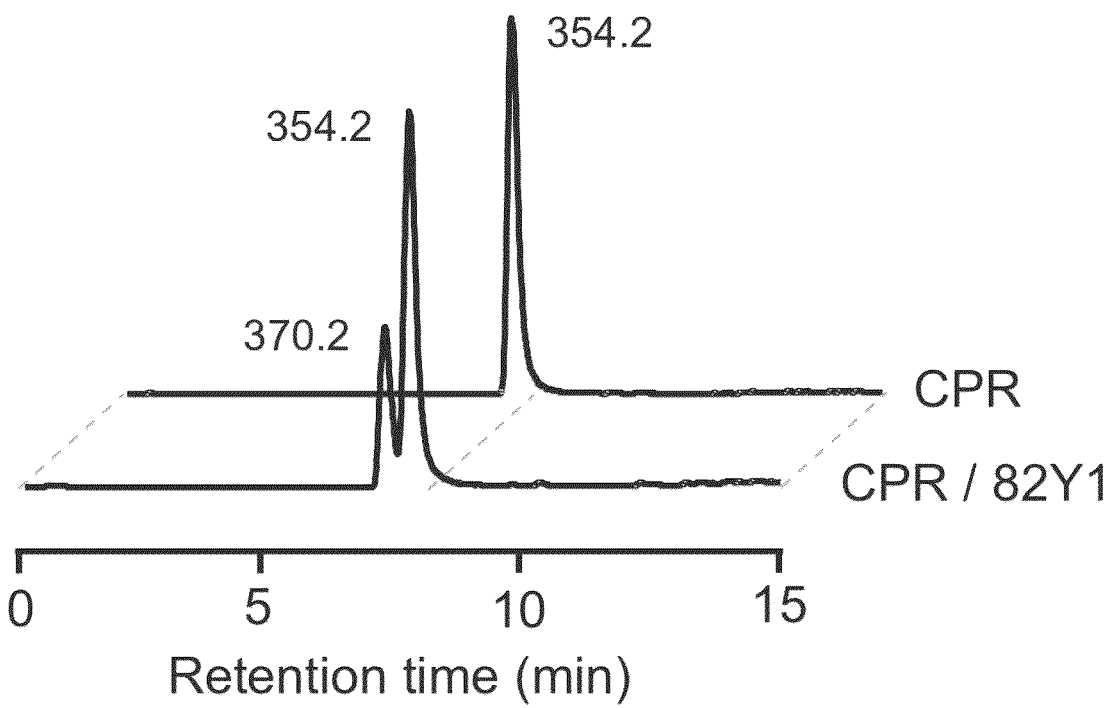
FIG. 9 depicts an LC-MS/MS ion chromatogram showing the in vivo conversion of (S)—N-methylcanadine to 1-hydroxy-N-methylcanadine by CYP82Y1. Shown is the formation of a reaction product with m/z 370, which is absent in the control.

Yeast strains harboring the coding region of CYP82Y1 and pESC-leu2th:CPR, as a control, were grown on a medium comprising (S)—N-methylcanadine. Microsomes were extracted as described in Example 3. Enzyme assays were performed as in example 5, except that no exogenous enzyme substrate was included in the assay. LC-MS/MS was performed as described in Example 5. FIG. 9 shows the in vivo formation of a reaction product with m/z 370, which is absent in the control. The m/z 370 of the reaction product is identical to m/z 370 of the product the inventors have identified as 1-hydroxy-N-methylcanadine as described in Example 6. Accordingly this example demonstrates the in vivo production of 1-hydroxy-N-methylcanadine.

Example 9

In Vivo Production of Narcotine Hemiacetal in Plants

In this example, by inhibiting NOS in a plant using virus induced gene-silencing (VIGS), there is provided papaveroxine under conditions that permit the conversion of papaveroxine to produce narcotine-hemiacetal therefrom.

A NOS-specific silencing construct was designed as described previously (Winzer et al., 2012, Science 336, 1704-1708). A 323-bp fragment of NOS was inserted into the XbaI and KpnI sites of pTRV2. Primers used for amplification were: 5'-TGCATCTAGAGAAATTGACGAGA-CAATAT GG-3' (SEQ ID NO: 603) and 5'-TGCAGGTAC-CCATTCAAAAAC GAATATGTGTGC-3' (SEQ ID NO: 604). The pTRV2-NOS construct and pTRV2 empty vector were individually transformed into *Agrobacterium tumefaciens* strain GV3101 Bacterial preparation, plant infiltration, tissue collection, total RNA isolation, and first-strand cDNA synthesis were performed as described previously by Dang et al., 2012, Methods enzymol. 515; 231-266. PCR was performed using primers (5'-TTACTCAAGGAA GCAC-GATGAGC-3' (SEQ ID NO: 605) and 5'-GAACCG-TAGTTT AA TGTCTTCGGG-3' (SEQ ID NO: 606)) specific to sequences flanking the multiple cloning site of pTRV2 to confirm the presence of the transgene cassette. Positive samples were subjected to RT-qPCR to analyze NOS transcript abundance. Frozen latex samples were lyophilized for 72 h until completely dehydrated and extracted with 30 µL of methanol per milligram of dried latex for 48 h at 4° C. After centrifugation at 20,000 g for 10 min, the supernatant was diluted 500- or 5000-fold for LC-MS/MS analysis. LC-MS/MS was performed using a 6410 Triple Quadropole LC-MS/MS (Agilent Technologies, Santa Clara, Calif.) for identification and quantification of alkaloids. Chromatographic separation was achieved using a Poroshell 120 SB-018 HPLC column (Agilent Technologies) at a nitrogen flow rate of 0.7 mL/min using solvent A (10 mM ammonium acetate, pH 5.5, 5% acetonitrile) and Solvent B (100% acetonitrile) with the following gradient, i.e. 0-80% Solvent B from 0-6 minutes, 80-99% Solvent B from 6-7 minutes, isocratic 99% Solvent B from 7-8 minutes, 99-0% Solvent B from 8-8.1 minutes, followed by 0% Solvent B from 8.1-11.1 minutes. Electrospray ionization, full scan mass analyses (m/z range 200-700) and collisional MS/MS experiments were performed as described previously (Farrow et al., 2012, Phytochemistry 77: 79-88). Collision-induced dissociation (CID) spectra of noscapine (m/z 414) and narcotinhemiacetal (m/z 416) were acquired at 25 eV and 10 eV, respectively, and fragmentation patterns were used to confirm compound identities. Multiple-reaction monitoring (MRM) mass analysis with collision energy of 25 eV and the product ion of m/z 220 was used for quantification of noscapine and narcotine hemiacetal in kinetics analyses.

Figure 10:
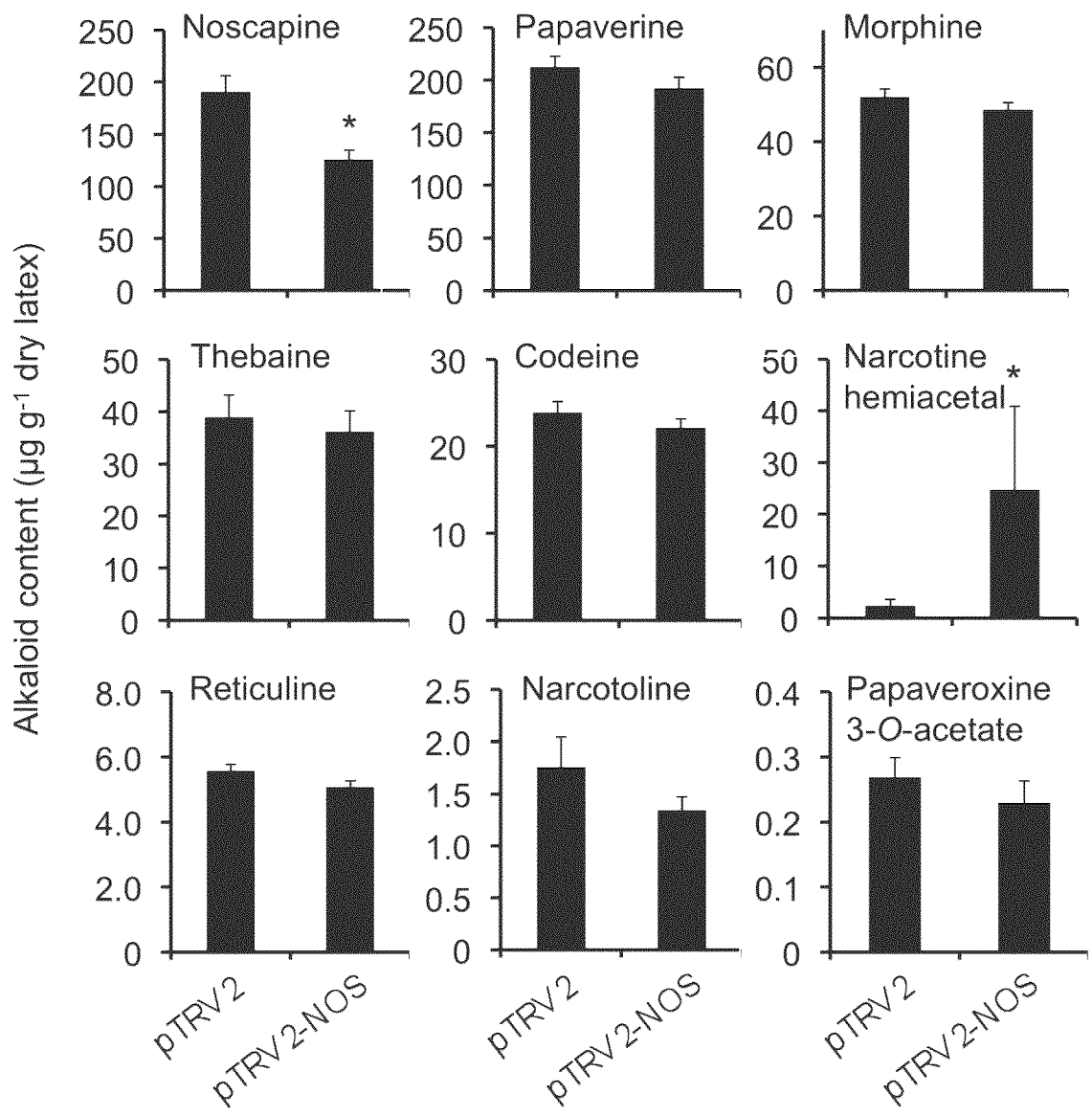
FIG. 10 depicts certain bar graphs showing the relative abundance of noscapine, narcotine hemiacetal and control alkaloids in infiltrated control (pTRV2) and NOS-silenced plants (pTRV-2-NOS).

The pTRV2-NOS construct was infiltrated along with pTRV1 into opium poppy seedlings. The pTRV2 empty vector (EV) in *A. tumefaciens* was also infiltrated into opium poppy seedlings as a negative control. A total of 22 and 16 successfully infiltrated plants were obtained for NOS-silencing and EV control constructs, respectively. qRT-PCR was used to quantify the relative abundance of NOS transcripts and LC-MS/MS was used to analyze the content of specific alkaloids in all infiltrated plants. Compared with the EV control, NOS transcript levels were significantly reduced by 71% in NOS-silenced plants (P<0.01). Correspondingly, the average noscapine content in NOS-silenced plants was also significantly reduced compared with EV controls (P<0.05) (FIG. 10). By contrast, narcotine hemiacetal accumulated at a significantly higher level in NOS-silenced plants compared with EV controls (P<0.01) (FIG. 10). Relative levels of other major BIAs and some key pathway intermediates did not show any significant differences (P>0.1) in NOS-silenced and EV control plants. The relative transcript abundances of several genes, many identified in the noscapine gene cluster and all putatively involved in noscapine biosynthesis, were unaffected by the suppression of NOS transcript.

Example 10

In Vivo Production of (S)—N-Methylcanadine in a Plant

In this example, by inhibiting CYP82Y1 in a plant using virus induced gene-silencing (VIGS), there is provided (S)—N-methylcanadine.

A sequence encompassing part of the 3'-UTR and coding region of CYP82Y1 was used to construct a VIGS vector. The fragment was cloned into pTRV2 and vectors were mobilized in *Agrobacterium tumefaciens* as described previously (Dang and Facchini, 2012, Plant Physiol. 159: 618-631). Apical meristems of two to three week-old seedlings were infiltrated with a 1:1 mixture of *A. tumefaciens* harboring pTRV1 and either pTRV2::CYP82Y1 or pTRV2. Infiltrated plants were grown in the greenhouse for 8-10 weeks. Visual confirmation of gene silencing was monitored using the pTRV2-PDS construct encoding phytoene desaturase. Latex and stems of infiltrated opium poppy was collected immediately prior to anthesis as described previously (Dang and Facchini, 2012, Plant Physiol. 159: 618-631). Briefly, a 1-cm stem segment below the flower bud and approximately 10 µL of exuding latex were collected for alkaloid analysis. Infiltration with *A. tumefaciens* was confirmed by detection of the RNA corresponding to the TRV2 transgene cassette in VIGS-treated plants using TRV-MCS primers specific to sequences flanking the multiple cloning site of pTRV2, and using glyceraldehyde 3-phosphate dehydrogenase (GAPDH) as a positive control. Latex samples from infiltrated plants were lyophilized, resuspended in methanol at a concentration of 0.1 μg μL$^{-1}$ and extracted overnight in −80° C. Transcript analysis of infiltrated plants was performed by real-time quantitative PCR (RT-qPCR) using a 7300 Real-Time PCR system (Applied Biosystems, Burlington, Ontario, Canada) for 40 cycles of template denaturation, primer annealing, and primer extension. Each 10-μL PCR contained 1 μL of cDNA, 300 nM forward and reverse primers, and 1×KAPA SYBR FAST qPCR Kit (Kapa Biosystems, Boston, Mass.). The opium poppy gene encoding ubiquitin was used as an endogenous reference and plant lines showing the highest expression level served as the calibrator for each target gene. Dissociation curve analysis was used to validate qPCR specificity. Relative gene expression data were analyzed using the $2^{-\Delta\Delta Ct}$ method (Livak and Schmittgen, 2001, Methods 25: 402-431) based on 54 independent values (i.e. 3 technical replicates performed on each of 3 stem segments taken from each of 6 individual plants). Statistical analysis was performed using an unpaired, two-tailed Student t test. LC-MS/MS was carried out as described in example 5, except that samples were diluted 1:1000 with solvent A and elution conditions were 0 to 6 min 60% solvent B, 6 to 9 min ramp to 99% solvent B, 9 to 14 min isocratic at 99% solvent B, and 14 to 18 min ramp to 0% solvent B, and ions were generated and focused using the following parameters capillary voltage, 4000 kV; gas flow, 10 L min$^{-1}$; fragmentor voltage, 100 V; nebulizer pressure, 50 psi; gas temperature, 350° C.

Figure 11:
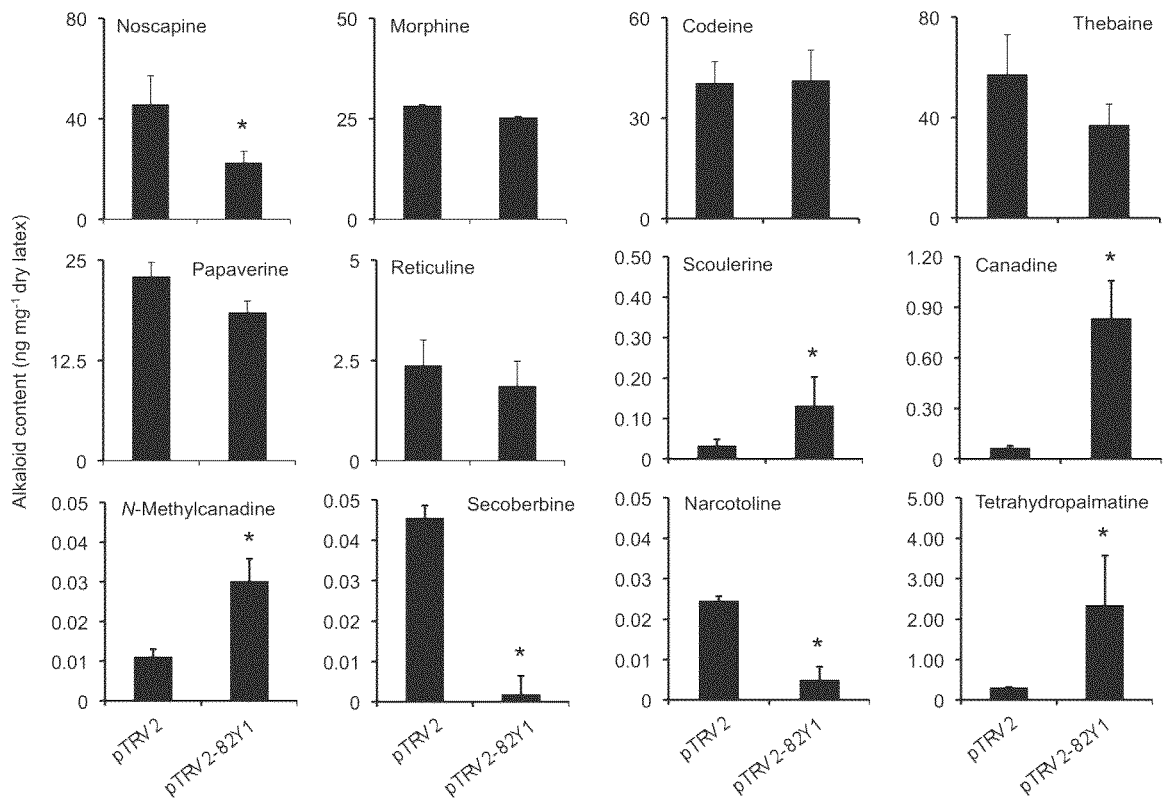
FIG. 11 depicts certain bar graphs showing the relative abundance of noscapine, N-methylcanadine and control alkaloids in infiltrated control (pTRV2) and CYP82Y1 plants (pTRV-2-82Y1).

TRV infection of infiltrated plants was confirmed by reverse transcription-PCR amplification of TRV2 RNA. CYP82Y1 transcript levels were significantly reduced in plants infiltrated with *A. tumefaciens* harboring the pTRV2-82Y1 construct compared with the empty pTRV2 vector control. Total alkaloid content, and the levels of major alkaloids including morphine, codeine, reticuline, and thebaine were not altered in CYP82Y1-silenced plants compared with controls. However, the suppression of CYP82Y1 transcript levels significantly reduced the accumulation of noscapine, while CYP82Y1-silenced plants accumulated increased levels of N-methylcanadine (FIG. 11).

Example 11

Isolation of a Nucleic Acid Sequence Encoding CYP82X2

Opium poppy (*Papaver somniferum*) chemotypes Bea's Choice and Veronica were cultivated at 20/18° C. (light/dark) in a growth chamber (Conviron, Winnipeg, Canada) with a photoperiod of 16 h and a combination of Cool White fluorescent (Sylvania, Mississauga, Canada) and incandescent lighting. Total RNA and alkaloid extractions from the latex of eight opium poppy chemotypes were subjected to transcript and metabolite profiling, respectively, as described previously (Desgagné-Penix et al. 2010, BMC Plant Biol. 10: 252; Dang and Facchini 2012, Plant Physiol. 159-618-631). CYP82X2 was identified among genes differentially expressed in noscapine-free (Deborah, Przemko, 40 and T) and noscapine-producing (Natasha, Marianne, Roxanne, and Veronica) chemotypes of opium poppy (Desgagné-Penix et al. 2010, BMC Plant Biol. 10: 252). The full-length coding region of CYP82X2, was assembled in silico by searching each database using the tBLASTn algorithm, and is provided herein as SEQ.ID NO:3. The deduced amino acid sequence is provided herein as SEQ.ID NO:4. Relative transcript abundance was determined as the number of reads corresponding to each selected candidate compared with the total number of reads in each database (Dang and Facchini 2012, Plant Physiol. 159-618-631).

Example 12

Isolation of a Nucleic Acid Sequence Encoding CYP82X1

Opium poppy (*Papaver somniferum*) chemotypes Bea's Choice and Veronica were cultivated at 20/18° C. (light/dark) in a growth chamber (Conviron, Winnipeg, Canada) with a photoperiod of 16 h and a combination of Cool White fluorescent (Sylvania, Mississauga, Canada) and incandescent lighting. Total RNA and alkaloid extractions from the latex of eight opium poppy chemotypes were subjected to transcript and metabolite profiling, respectively, as described previously (Desgagné-Penix et al. 2010, BMC Plant Biol. 10: 252; Dang and Facchini 2012, Plant Physiol. 159-618-631). CYP82X1 was identified among genes differentially expressed in noscapine-free (Deborah, Przemko, 40 and T) and noscapine-producing (Natasha, Marianne, Roxanne, and Veronica) chemotypes of opium poppy (Desgagné-Penix et al. 2010, BMC Plant Biol. 10: 252). The full-length coding region of CYP82X1, was assembled in silico by searching each database using the tBLASTn algorithm, and is provided herein as SEQ.ID NO:7. The deduced amino acid sequence is provided herein as SEQ.ID NO:8. Relative transcript abundance was determined as the number of reads corresponding to each selected candidate compared with the total number of reads in each database (Dang and Facchini 2012, Plant Physiol. 159-618-631).

Example 13

Isolation of a Nucleic Acid Sequence Encoding AT1

Opium poppy (*Papaver somniferum*) chemotypes Bea's Choice and Veronica were cultivated at 20/18° C. (light/dark) in a growth chamber (Conviron, Winnipeg, Canada) with a photoperiod of 16 h and a combination of Cool White fluorescent (Sylvania, Mississauga, Canada) and incandescent lighting. Total RNA and alkaloid extractions from the latex of eight opium poppy chemotypes were subjected to transcript and metabolite profiling, respectively, as described previously (Desgagné-Penix et al. 2010, BMC Plant Biol. 10: 252; Dang and Facchini 2012, Plant Physiol. 159-618-631). AT1 was identified among genes differentially expressed in noscapine-free (Deborah, Przemko, 40 and T) and noscapine-producing (Natasha, Marianne, Roxanne, and Veronica) chemotypes of opium poppy (Desgagné-Penix et al. 2010, BMC Plant Biol. 10: 252). The full-length coding region of AT1, was assembled in silico by searching each database using the tBLASTn algorithm, and is provided herein as SEQ.ID NO:5. The deduced amino acid sequence is provided herein as SEQ.ID NO:6. Relative transcript abundance was determined as the number of reads corresponding to each selected candidate compared with the total number of reads in each database (Dang and Facchini 2012, Plant Physiol. 159-618-631).

Example 14

Isolation of a Nucleic Acid Sequence Encoding CXE1 and CXE2

Opium poppy (*Papaver somniferum*) chemotypes Bea's Choice and Veronica were cultivated at 20/18° C. (light/ dark) in a growth chamber (Conviron, Winnipeg, Canada) with a photoperiod of 16 h and a combination of Cool White fluorescent (Sylvania, Mississauga, Canada) and incandescent lighting. Total RNA and alkaloid extractions from the latex of eight opium poppy chemotypes were subjected to transcript and metabolite profiling, respectively, as described previously (Desgagné-Penix et al. 2010, BMC Plant Biol. 10: 252; Dang and Facchini 2012, Plant Physiol. 159-618-631). CXE1 and CXE2 were identified among genes differentially expressed in noscapine-free (Deborah, Przemko, 40 and T) and noscapine-producing (Natasha, Marianne, Roxanne, and Veronica) chemotypes of opium poppy (Desgagné-Penix et al. 2010, BMC Plant Biol. 10: 252). The full-length coding region of CXE1 and CXE2, was assembled in silico by searching each database using the tBLASTn algorithm, and is provided herein as SEQ.ID NO:11 and SEQ.ID NO: 15, respectively The respective deduced amino acid sequences are provided herein as SEQ.ID NO:12. And SEQ.ID NO: 16. Relative transcript abundance was determined as the number of reads corresponding to each selected candidate compared with the total number of reads in each database (Dang and Facchini 2012, Plant Physiol. 159-618-631).

Example 15

Expression of CYP82X2 and CYP82X1 in Yeast and AT1, CXE1 and CXE2 in E. coli

Figure 12:
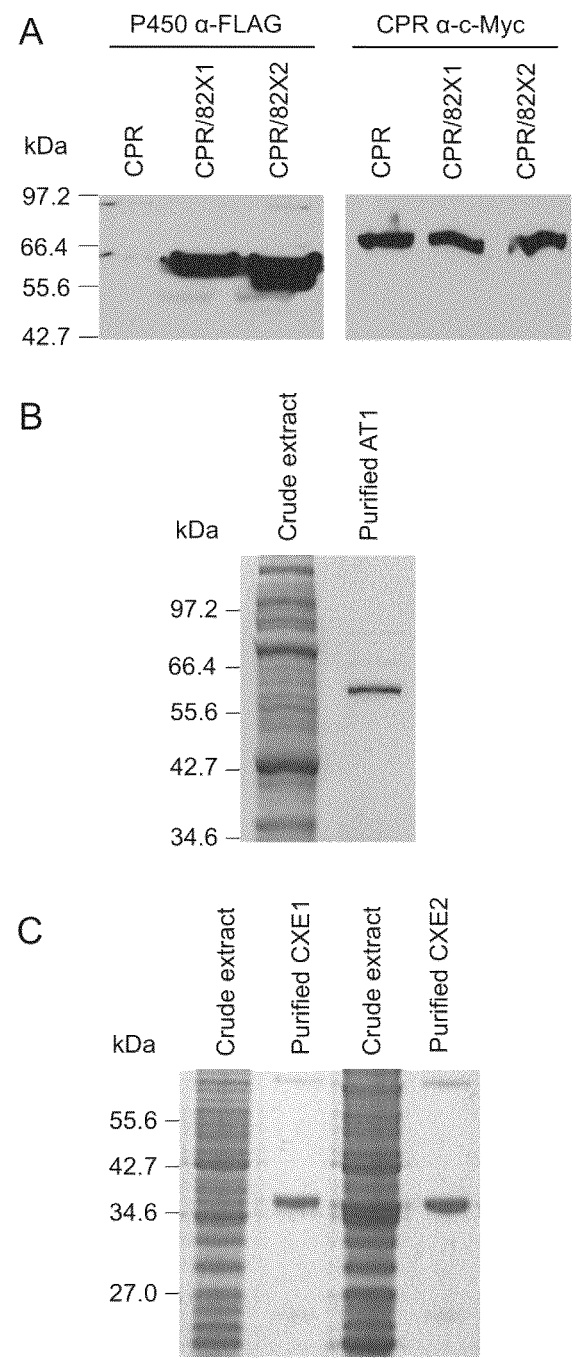
FIG. 12 depicts an immunoblot showing the expression of α-FLAG-tagged CYP82X1 and CYP82X2, and α-c-Myc-taged cytochrome P450 reductase (CPR) in microsomal fractions of Saccharomyces cerevisiae and expression of AT1, CXE1 and CXE2 in Escherichia coli. Shown are an immunoblot (FIG. 12A) and coomassie blue stained gels (FIG. 12B and FIG. 12 C).

The full-length coding region of CYP82X1 was amplified using cDNA derived from total stem RNA of the Bea's Choice chemotype using Takara Ex Taq DNA polymerase (Fisher Scientific, Ottawa, Canada), and using a primer 5'-GCGGCCGCGCCATGGTTATTCATAAAG-3' (SEQ ID NO: 607) and reverse primer 5'-CATACCTAGTGCAAC-CCATGAATAAGAGCCGC-3' (SEQ ID NO: 608). Owing to problems with heterologous expression in yeast, CYP82X2 was synthesized with the first 60 N-terminal amino acids replaced with the first 43 N-terminal amino acids from the lettuce cytochrome P450 germacrene A oxidase Nguyen, D. T. et al. J. Biol. Chem. 285, 16588-16598 (2010). For heterologous expression of Flag-tagged CYPs in yeast (Saccharomyces cerevisiae), the full-length coding regions of CYP82X1 and CYP82X2 were inserted into the NotI and SpeI restriction sites of the dual plasmid pESC-leu2d::CPR Ro, D.-K., Ouellet, M., Paradise, E. M., Burd, H., Eng, D., Paddon, C. J., Newman, J. D., & Keesling, J. D. BMC Biotech. 8, 83 (2008) yielding pESC-Leu2d::CYP82X1/CPR and pESC-Leu2d::CYP82X2/CPR. The protease-deficient yeast strain YPL 154C:Pep4 was transformed with pESC-Leu2d::CYP82X1/CPR and pESC-Leu2d::CYP82X2/CPR. Yeast culture, microsome preparation, and immunoblot analysis were performed as described previously Dang, T.-T. T. & Facchini, P. J. J. Biol. Chem. 289, 2013-2026 (2014). For heterologous expression of CXE1, CXE2, and AT1, corresponding open reading frames were amplified using cDNA derived from total stem RNA of the Bea's Choice chemotype and cloned in-frame an N-terminal His-tag sequence in the Escherichia coli expression vector pRSETA (Invitrogen, Carlsbad, Calif.). CXE1 and CXE2 were individually inserted into the SacI and HindIII restriction sties, whereas AT1 was inserted into the KpnI and HindIII sites, of pRSETA using a primer 5'-GACTGGTAC-CATATGGCAACAATGTCTAGTGCTGCTGTAGTA-3' (SEQ ID NO: 609) and reverse primer 5'-GACTAAGCT-TCACTAAAACAGTTGGAGGATCTCT CTTAGGTG-3' (SEQ ID NO: 610). Expression constructs were transformed into E. coli strain Rosetta (DE3) pLysS (EMD Chemicals, Darmstadt, Germany). Expression of recombinant CXE1, CXE2, and AT1 was induced using 1 mM isopropyl β-D-thiogalactoside (IPTG) at 37° C. for 5-6 h. Protein purification was performed as described previously (Chen, X. & Facchini, P. J. Plant J. 77, 173-184 (2014)). Results of the expression and purification of CYP82X1, CYP82X2, AT1, CXE1 and CXE2 are shown in FIG. 12. Microsomal fractions containing recombinant CYP82X1 or CYP82X2 were detected using a-FLAG antibodies, whereas recombinant CPR was detected using α-c-Myc antibodies (FIG. 12 A). Each lane contained 2 μg of total microsomal protein. A coomassie blue-stained, denaturing polyacrylamide gel showing the production of AT1 in E. coli and purification of the His-tagged recombinant enzyme is shown in FIG. 12 B. A coomassie blue-stained, denaturing polyacrylamide gel showing the production of CXE1 and CXE2 in E. coli, and purification of the His-tagged recombinant enzymes is shown in FIG. 12 C. Expression constructs were used to transform the E. coli Rosetta strain, and recombinant protein production was induced using 1 mM isopropyl β-D-thiogalactoside (IPTG). Purification of His-tagged recombinants proteins was performed using cobalt-affinity chromatography.

Example 16

Figure 13:
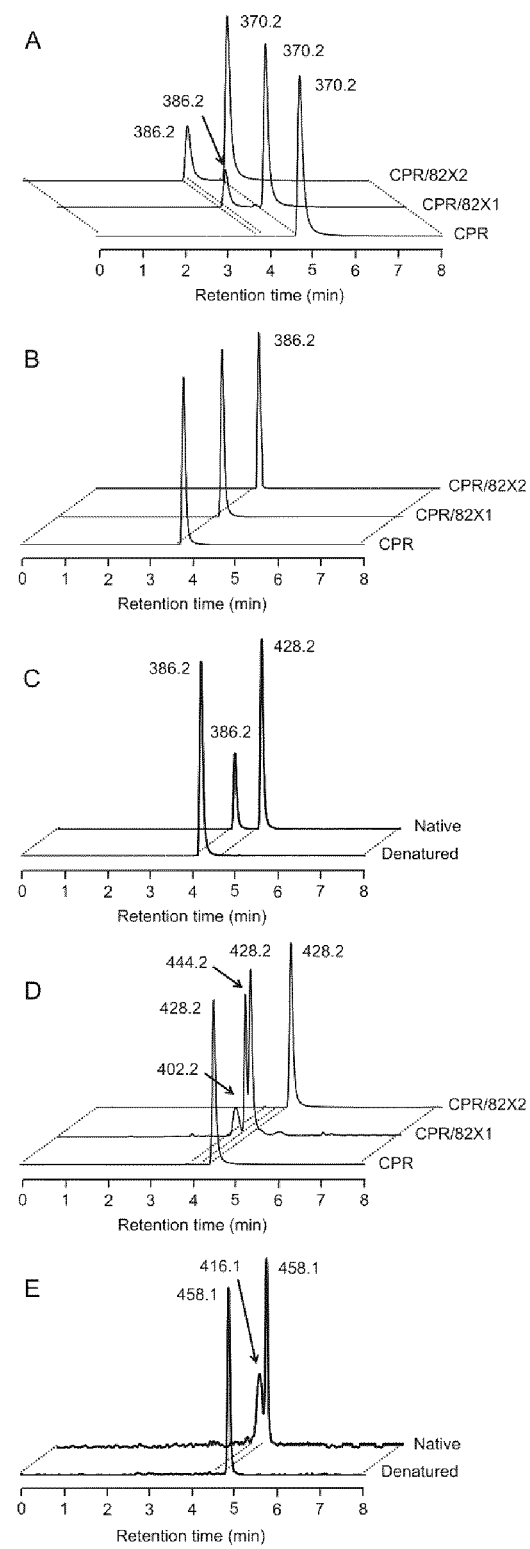
FIG. 13 depicts various LC-MS/MS ion chromatograms showing in vitro activity of CYP82X2, AT1, CYP82X1, and CXE1 and production of 1,13 dihydroxy-N-methylcanadine, 1-hydroxy-13-O-acetyl-N-methylcanadine, 4'desmethoxy-3-O-acetyl-papaveroxine, narcotoline hemiacetal and narcotine hemiacetal. Shown are: (A) in vitro catalytic activities of CYP82X2 (CPR/82X2) and CYP82X1 (CPR/82X1) on (S)-1-hydroxy-N-methylcanadine (m/z 370) yielding (S)-1,13-dihydroxy-N-methylcanadine (m/z 386) and 4-O-demethylmacrantaldehyde (m/z 386), respectively.

In Vitro Activity of CYP82X2, AT1, CYP82X1, and CXE1; Production of 1,13 Dihydroxy-N-Methylcanadine, 1-Hydroxy-13-O-Acetyl-N-Methylcanadine, 4'Desmethoxy-3-O-Acetyl-Papaveroxine, Narcotoline Hemiacetal and Narcotine Hemiacetal Yeast microsomal fractions for assaying CYP82X1 and CYP82X2 prepared as described in Example 3. Aliquots of enzyme substrates were exogenously added to the microsomal fractions. Enzyme assays were performed in 200 μL of 100 mM HEPES-NaOH, pH 7.5, containing 0.5 mg of total microsomal proteins, 50 μM (S)—N-methylcanadine and 500 μM NADPH. The reaction was conducted on a gyratory shaker with gentle agitation (60 rpm) at 30° C. for 20 min. The reaction was stopped by the addition of 800 μL methanol. Control assays were performed with microsomal protein extracts from yeast harboring pESC-leu2th:CPR. In vitro standard of CXE1 and CXE2 assays were performed at 30° C. for 15 min in a 40 μL of 100 mM Tris-HCl, pH 8.0, containing 50 μM of 3-O-acetylpapaveroxine, and purified protein (0.24 μg for CXE1 and 0.04 μg for CXE2). In vitro AT1 assays were performed at 30° C. for 15 min in 40 μL of 100 mM Tris-HCl, pH 8.0, containing 50 μM acetyl-CoA, 50 μM (S)-1,13-dihydroxy-N-methylcanadine, and 0.2 μg of purified protein. Reactions were quenched with 500 μL of acetonitrile, centrifuged at 20,000 g for 10 min, and the supernatant was subjected to LC-MS/MS analysis. Results were evaluated using LC-MS/MS. Experiments were performed using an LTQ-Orbitrap XL equipped with a syringe pump and an Accela HPLC system (ThermoFisher Scientific, Waltham, Mass.). Reaction products were reduced to dryness and redissolved in acetonitrile, and were introduced directly into the LTQ-Orbitrap with a syringe pump at a rate of 5 μL min$^{-1}$. ESI was performed as follows: sheath gas 10 au; 4.5 kV spray voltage. Ion interface settings were 275° C. and 19 V (capillary) and 60 V (tube lens). Reaction products were fractionated by HPLC using a flow rate of 500 μL min$^{-1}$ and the following gradient: Solvent A (10 mM ammonium acetate, pH 4.5), 100 to 80% (v/v) over 5 min, 80 to 50% (v/v) over 3 min, 50 to 0% (v/v) over 3 min. All products eluted before 10 min. Solvent B was 100% acetonitrile. For HPLC infusion, heated ESI was performed as follows: heater 400° C., sheath gas 60 au, auxiliary gas 20 au, spray voltage 3 kV. Ion interface settings were 380° C. and 6 V (capillary) and 45 V (tube lens). Mass spectrometry data were acquired in positive ion mode in various ranges of m/z 370-458. Results are shown in FIG. 13. Extracted ion chromatograms (EICs) show the in vitro catalytic activities of CYP82X2 (CPR/82X2) and CYP82X1 (CPR/82X1) on (S)-1-hydroxy-N-methylcanadine (m/z 370) yielding (S)-1,13-dihydroxy-N-methylcanadine (m/z 386) and 4-O-demethylmacrantaldehyde (m/z 386), respectively. No reaction products were detected in the negative control (CPR) (FIG. 13A). No products were detected when either CYP82X1 (CPR/82X1) or CYP82X2 (CPR/82X2) was incubated with (S)-1,13-dihydroxy-N-methylcanadine (m/z 386) (FIG. 13 B). EICs show the activity of native recombinant AT1 on (S)-1,13-dihydroxy-N-methylcanadine (m/z 386), forming (S)-1-hydroxy-13-O-acetyl-N-methylcanadine (m/z 428). Denatured AT1 was inactive (FIG. 13 C). EICs show the activity of CYP82X1 (CPR/82X1) converting (S)-1-hydroxy-13-O-acetyl-N-methylcanadine (m/z 428) to (S)-1,8-dihydroxy-13-O-acetyl-N-methylcanadine, which spontaneously rearranges to form 4'-O-desmethyl-3-O-acetylpapaveroxine (m/z 444). Spontaneous loss of the acetyl group yields narcotoline hemiacetal (m/z 402). CYP82X2 (CPR/82X2) showed no activity with (S)-1-hydroxy-13-O-acetyl-N-methylcanadine. No reaction products were detected in the negative control (CPR) (FIG. 13D). EICs show cleavage of the O-acetyl moiety from 3-O-acetylpapaveroxine (m/z 458) by native recombinant CXE1 yielding papaveroxine, which spontaneously rearranges to form narcotine hemiacetal (m/z 416). Denatured CXE1 was inactive (FIG. 13 E).

Example 18

Figure 14:
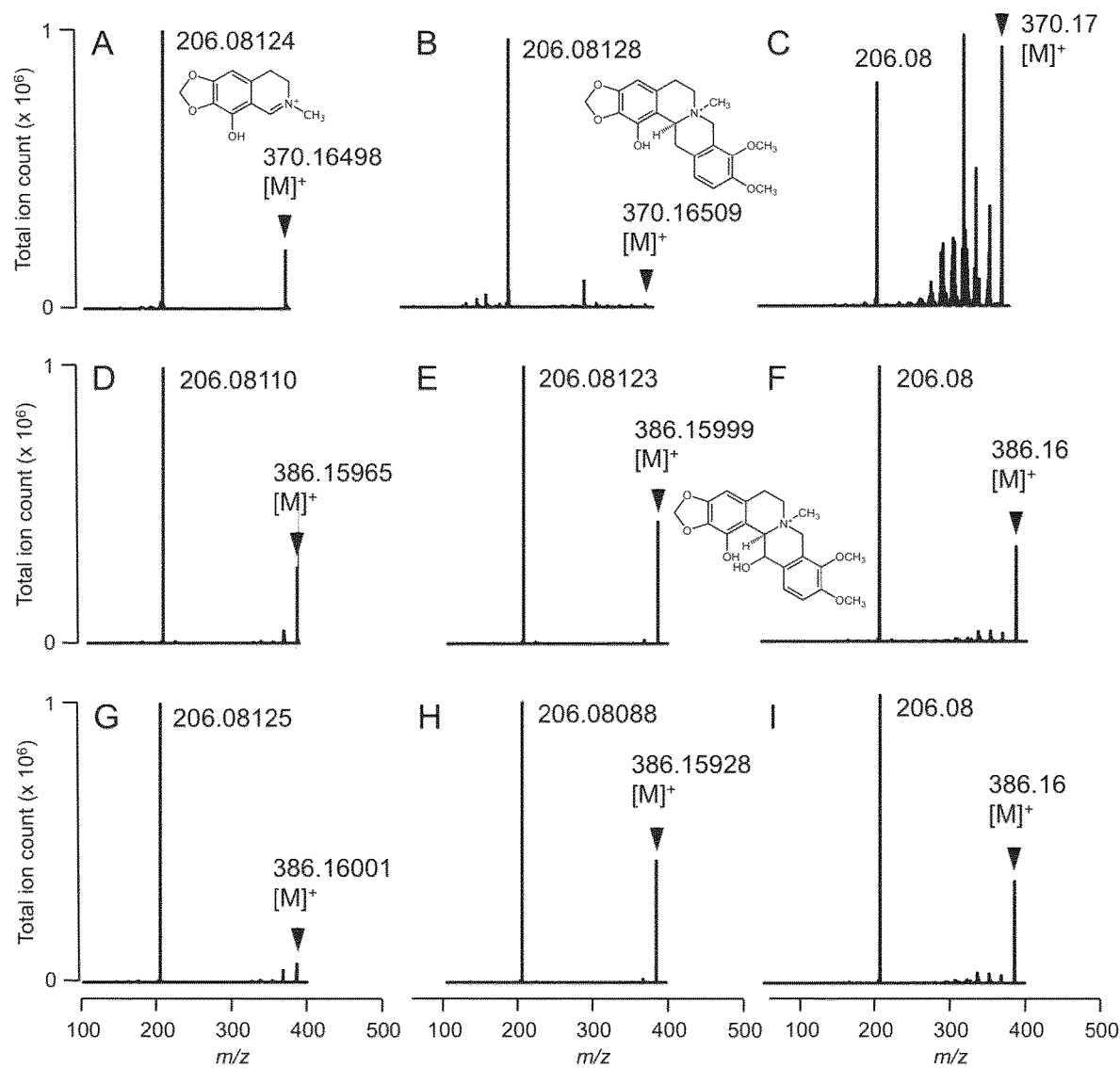
FIG. 14 shows certain high-resolution collision-induced dissociation (CID), higher-energy collision-induced dissociation (HCD), and non-collisional pulsed Q dissociation (PQD) spectra relating to CYP82X2 substrates and reaction products. Shown are high-resolution CID (FIG. 14 A, D, G) and HCD (FIG. 14 B, E, H), and low-resolution PQD (FIG. 14 C, F, I) to compare the spectra of the enzymatic substrate (1-hydroxy-N-methylcanadine, m/z 370, FIG. 14 A, B, C), the CYP82X2 reaction product (m/z 386, FIG. 14 D, E, F), and an authentic standard of (S)-1,13-dihydroxy-N-methyl-canadine (m/z 386, FIG. 14 G, H, I). Arrowheads indicate parent ions.

Identification of the CYP82X2 Reaction Product as 1,13-Dihydroxy-N-Methylcanadine High-resolution collision-induced dissociation (CID), higher-energy collision-induced dissociation (HCD), and non-collisional pulsed Q dissociation (PQD) analyses were conducted to confirm the identity of yeast produced CYP82X2 reaction products by comparison with authentic standards. Experiments were performed using an LTQ-Orbitrap XL equipped with a syringe pump and an Accela HPLC system (ThermoFisher Scientific, Waltham, Mass.). Reaction products were reduced to dryness and redissolved in acetonitrile, and were introduced directly into the LTQ-Orbitrap with a syringe pump at a rate of 5 µL min$^{-1}$. ESI was performed as follows: sheath gas 10 au; 4.5 kV spray voltage. Ion interface settings were 275° C. and 19 V (capillary) and 60 V (tube lens). Reaction products were fractionated by HPLC using a flow rate of 500 µL min$^{-1}$ and the following gradient: Solvent A (10 mM ammonium acetate, pH 4.5), 100 to 80% (v/v) over 5 min, 80 to 50% (v/v) over 3 min, 50 to 0% (v/v) over 3 min. All products eluted before 10 min. Solvent B was 100% acetonitrile. For HPLC infusion, heated ESI was performed as follows: heater 400° C., sheath gas 60 au, auxiliary gas 20 au, spray voltage 3 kV. Ion interface settings were 380° C. and 6 V (capillary) and 45 V (tube lens). CID was performed on ions isolated and fragmented in the linear ion trap followed with high-resolution (60,000 FWHM) mass analysis in the Orbitrap. HCD was performed in the HCD cell followed with high-resolution mass analysis in the Orbitrap. Non-collisional PQD was performed and analyzed in the linear ion trap. Full-scan data was collected in centroid (CID and HCD) or profile (PQD) mode over mass ranges extending from the lowest permissible value up to 10 atomic mass units beyond the parent ion. CID, HCD and PQD were each performed separately (i.e. the parallel detection feature was not used). External and internal instrument calibration ensured an error of <2 ppm for high-resolution experiments. CYP82X2 was prepared from yeast expressing CYP82X2 as described in Example 15. FIG. 14 shows the results of the three different ion dissociation methods used (high-resolution CID (FIG. 14 A, D, G), HCD (FIG. 14 B, E, H), and low-resolution PQD (FIG. 14 C, F, I)) to compare the spectra of the enzymatic substrate (1-hydroxy-N-methylcanadine, m/z 370, FIG. 14 A, B, C), the CYP82X2 reaction product (m/z 386, FIG. 14 D, E, F), and an authentic standard of (S)-1,13-dihydroxy-N-methylcanadine (m/z 386, FIG. 14 G, H, I). In all cases, fragmentation spectra of the CYP82X2 reaction product were identical to corresponding spectra of the authentic standard. The results provided in this Example 18 demonstrate that CYP82X2 is capable of catalyzing a chemical reaction involving the use of 1-hydroxy-N-methylcanadine as a substrate, to form 1-13-dihydroxy-N-methylcanadine.

Example 19

Identification of AT1 Reaction Product as 1-Hydroxy-13-O-Acetyl-N-Methylcanadine NMR analysis was used to confirm the identity of the AT1 reaction product as follows. A scaled-up standard AT1 reaction using E. coli produced AT1 prepared essentially as described in Example 15, was performed to produce sufficient product from (S)-1,13-dihydroxy-N-methylcanadine for NMR analysis. The reaction was terminated by the addition of an equal volume of acetonitrile and precipitated protein was removed by centrifugation. Product purification from the concentrated supernatant was performed by preparative HPLC (Moravek Biochemicals, Brea, Calif.). Approximately 0.5 mg of (S)-1,13-dihydroxy-N-methylcanadine and 0.5 mg of (S)-1-hydroxy-13-O-acetyl-N-methylcanadine were independently dissolved in a solvent system consisting of 200 µL CDCl$_3$ and 50 µL D$_3$-CAN, and subjected to $^1$H, $^{13}$C, COSY, HSQC and HMBC NMR analysis on an Agilent DD2 700 MHz spectrometer. The NMR data unequivocally confirmed the AT1 reaction product as (S)-1-hydroxy-13-O-acetyl-N-methylcanadine, which showed the same backbone structure as (S)-1,13-dihydroxy-N-methylcanadine with the exception of an acetyl group bound to the C13 oxygen. The results of the NMR analysis are shown in FIG. 15. Data for the enzymatic substrate (S)-1,13-dihydroxy-N-methylcanadine (m/z 386) and the AT1 reaction product (S)-1-hydroxy-13-O-acetyl-N-methylcanadine (m/z 428) are shown. (S)-1-Hydroxy-13-O-acetyl-N-methylcanadine displays the same backbone structure as (S)-1,13-dihydroxy-N-methylcanadine, but includes an additional acetyl ester linked to the C13 oxygen. The results provided in this Example 19 demonstrate that AT1 is capable of catalyzing a chemical reaction involving the use of 1,13-dihydroxy-N-methylcanadine as a substrate, to form 1-hydroxy-13-O-acetyl-N-methylcanadine.

Example 20

Figure 16:
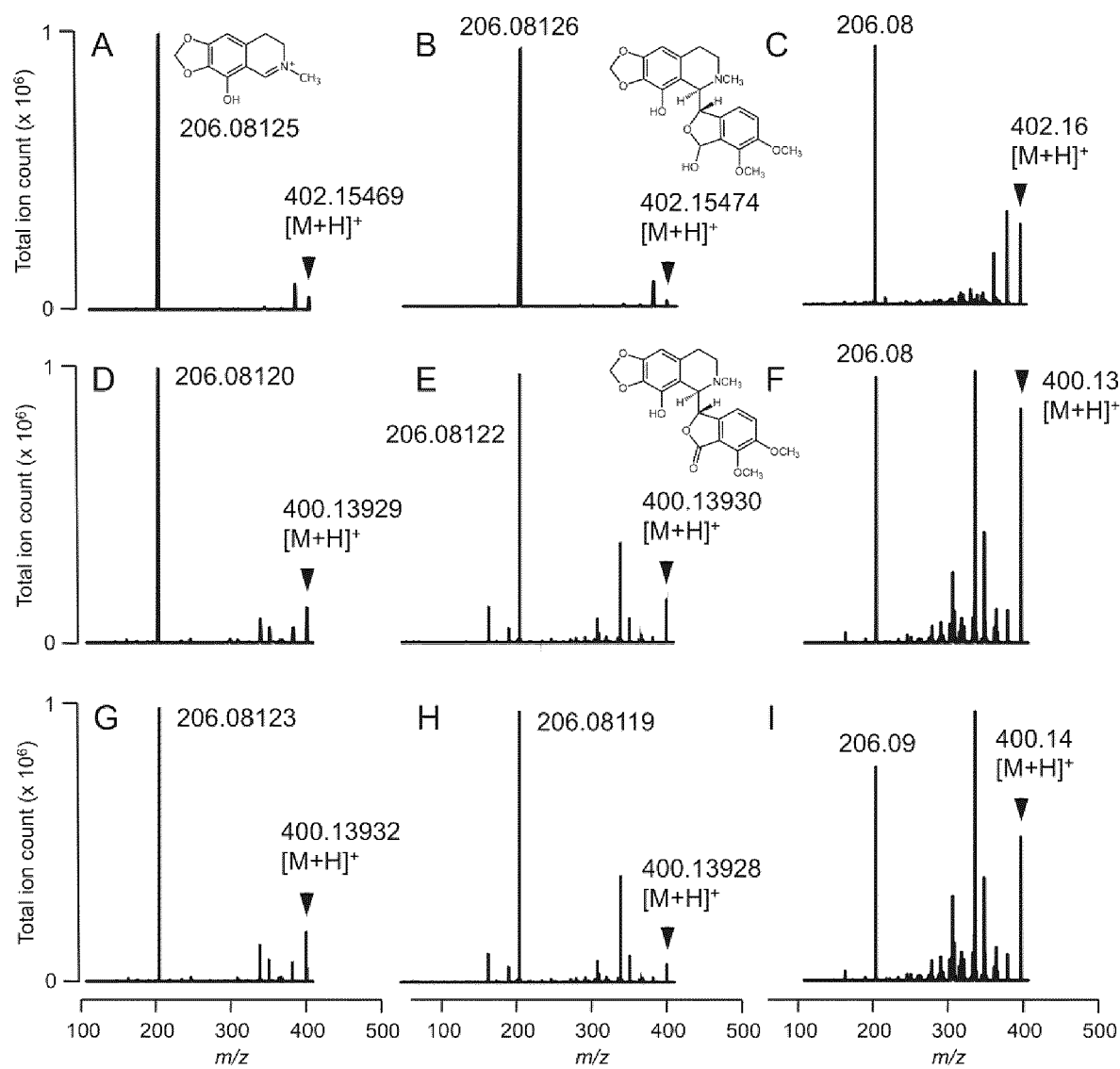
FIG. 16 shows certain high-resolution collision-induced dissociation (CID), higher-energy collision-induced dissociation (HCD), and non-collisional pulsed Q dissociation (PQD) spectra relating to CYP82X1. Shown are high-resolution CID (FIG. 16 A, D, G) and HCD (FIG. 16 B, E, H), and low-resolution PQD (FIG. 16 C, F, I), to compare the spectra of the enzymatic reaction product (narcotoline hemiacetal, m/z 402, FIG. 16 A, B, C), the NOS reaction product (m/z 400, FIG. 16 D, E, F), and an authentic standard of narcotoline (m/z 400, FIG. 16 G, H, I). Arrowheads indicate parent ions.

Identification of CYP82X1 Reaction Product as 4'-O-Desmethyl-3-O-Acetylpapaveroxine and Narcotoline Hemiacetal High-resolution collision-induced dissociation (CID), higher-energy collision-induced dissociation (HCD), and non-collisional pulsed Q dissociation (PQD) analyses were conducted to confirm the identity of the CYP82X1 reaction products by comparison with authentic standards, following procedures as further described in Example 18 and using yeast produced CYP82X1 prepared as described in Example 15. FIG. 16 shows that two CYP82X1 reaction products are produced from the enzymatic substrate (S)-1-hydroxy-13-O-acetyl-N-methylcanadine (m/z 428): 4'-O-desmethyl-3-O-acetylpapaveroxine (m/z 444) and narcotoline hemiacetal (m/z 402). Incubation of the CYP82X1 reaction products with noscapine synthase (NOS) yielded a new compound consistent with narcotoline (m/z 400). Three different ion dissociation methods, high-resolution CID (FIG. 16 A, D, G) and HCD (FIG. 16 B, E, H), and low-resolution PQD (FIG. 16 C, F, I), were used to compare the spectra of the enzymatic reaction product (narcotoline hemiacetal, m/z 402, FIG. 16 A, B, C), the NOS reaction product (m/z 400, FIG. 16 D, E, F), and an authentic standard of narcotoline (m/z 400, FIG. 16 G, H, I). In all cases, fragmentation spectra of the NOS reaction product derived from the CYP82X1 reaction product narcotoline hemiacetal (m/z 402) were identical to corresponding spectra of the authentic standard. The results provided in this Example 20 demonstrate that CYP82X1 is capable of catalyzing a chemical reaction involving the use of 1-hydroxy-13-O-acetyl-N-methylcanadine as a substrate, to form 4'-O-desmethyl-3-O-acetylpapaveroxine and narcotoline hemiacetal.

Example 21

Identification of Narcotine Hemiacetal as the Reaction Product of CXE1 and CEX2

Figure 17:
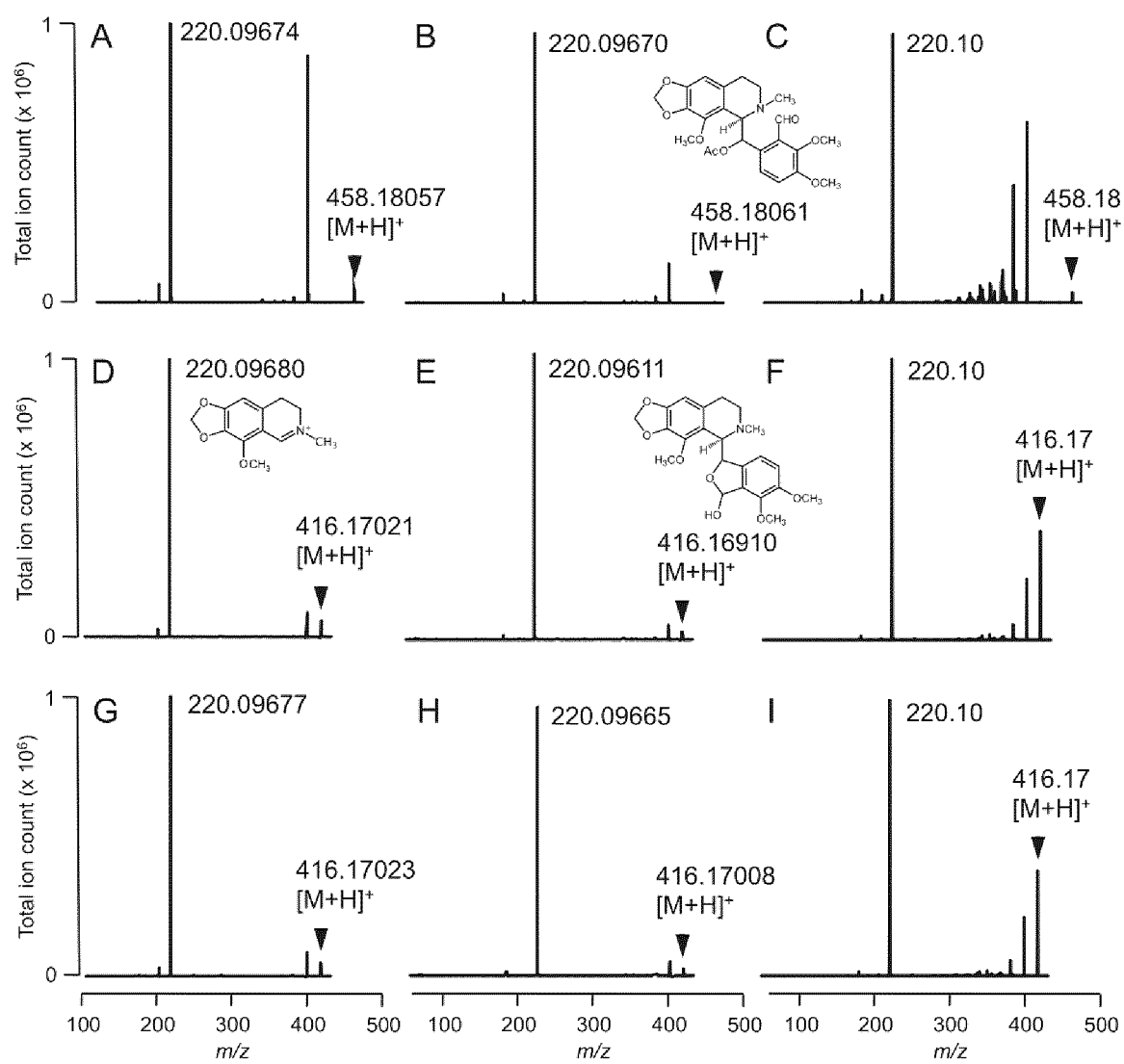
FIG. 17 shows certain high-resolution collision-induced dissociation (CID), higher-energy collision-induced dissociation (HCD), and non-collisional pulsed Q dissociation (PQD) spectra relating to CXE1. Shown are high-resolution CID (FIG. 17 A, D, G) and HCD (FIG. 17 B, E, H), and low-resolution PQD (FIG. 17 C, F, I), to compare the spectra of the enzymatic substrate (3-O-acetylpapaveroxine, m/z 458, FIG. 17 A, B, C), the CXE1 reaction product (m/z 416, FIG. 17 D, E, F), and an authentic standard of narcotine hemiacetal (m/z 416, FIG. 17 G, H, I). Arrowheads indicate parent ions.

High-resolution collision-induced dissociation (CID), higher-energy collision-induced dissociation (HCD), and non-collisional pulsed Q dissociation (PQD) analyses were conducted to confirm the identity of the CXE1 and CXE2 reaction products by comparison with authentic standards, following procedures as further described in Example 18 and using *E. coli* produced CXE1 and CXE2 prepared as described in Example 15. FIG. 17 shows three different ion dissociation methods, high-resolution CID (FIG. 17 A, D, G) and HCD (FIG. 17 B, E, H), and low-resolution PQD (FIG. 17 C, F, I) to compare the spectra of the enzymatic substrate (3-O-acetylpapaveroxine, m/z 458, FIG. 17 A, B, C), the CXE1 reaction product (m/z 416, FIG. 17 D, E, F), and an authentic standard of narcotine hemiacetal (m/z 416, FIG. 17 G, H, I). In all cases, fragmentation spectra of the CXE1 reaction product were identical to corresponding spectra of the authentic standard. Identical results were obtained for the CXE2 reaction product. The results provided in this Example 21 demonstrate that CXE1 and CXE2 are capable of catalyzing a chemical reaction involving the use of 3-O-acetylpapaveroxine as a substrate to form narcotine hemiacetal.

Example 22

Suppression of CYP82X2, AT1, CYP82X1, CXE1 and CXE2

Transcript levels of CYP82X1, CYP82X2, AT1, CXE1, and CXE2 in the Bea's Choice chemotype were suppressed using the tobacco rattle virus (TRV) vector system[12]. Unique sequences encompassing parts of the 3'-UTR and coding region of CYP82X1 and CYP82X2, and parts of the CXE1 and AT1 coding regions, were amplified using appropriate primers. Amplicons were individually cloned into pTRV2 and vectors were mobilized in *Agrobacterium tumefaciens* as described previously Dang, T. T. T., Onoyovwi, A., Farrow, S. C. & Facchini, P. J. *Methods Enzymol.* 515, 231-266 (2012). Apical meristems of two to three week-old seedlings were infiltrated with a 1:1 mixture of *A. tumefaciens* harboring pTRV1 and constructed pTRV2 containing the gene-specific fragments. Empty pTRV2 was used as a negative control and the pTRV2-PDS construct encoding phytoene desaturase was used as a positive infiltration control (Hileman, L. C., Drea, S., Martino, G., Litt, A., & Irish, V. F. *Plant J.* 44, 334-341 (2005)). Infiltrated plants were cultivated in the greenhouse for 8-10 weeks. Infiltration with *A. tumefaciens*, and collection and processing of latex and stem samples for alkaloid and transcript analysis were performed as described previously (Dang, T.-T. T. & Facchini, P. J. *J. Biol. Chem.* 289, 2013-2026 (2014); Chen, X. & Facchini, P. J. *Plant J.* 77, 173-184 (2014). Enzyme assays and VIGS experiments were analysed by LC-MS/MS as described previously (Dang, T.-T. T. & Facchini, P. J. *J. Biol. Chem.* 289, 2013-2026 (2014); Chen, X. & Facchini, P. J. *Plant J.* 77, 173-184 (2014). Chromatographic and spectral data used for the identification and relative quantification of alkaloids in opium poppy latex following the suppression of CYP82X1, CYP82X2, AT1, or CXE1 by virus-induced gene silencing were determined.

Example 23

Suppression of CYP82X2, In-Vivo Production of Noscapine Pathway Intermediates

Figure 18:
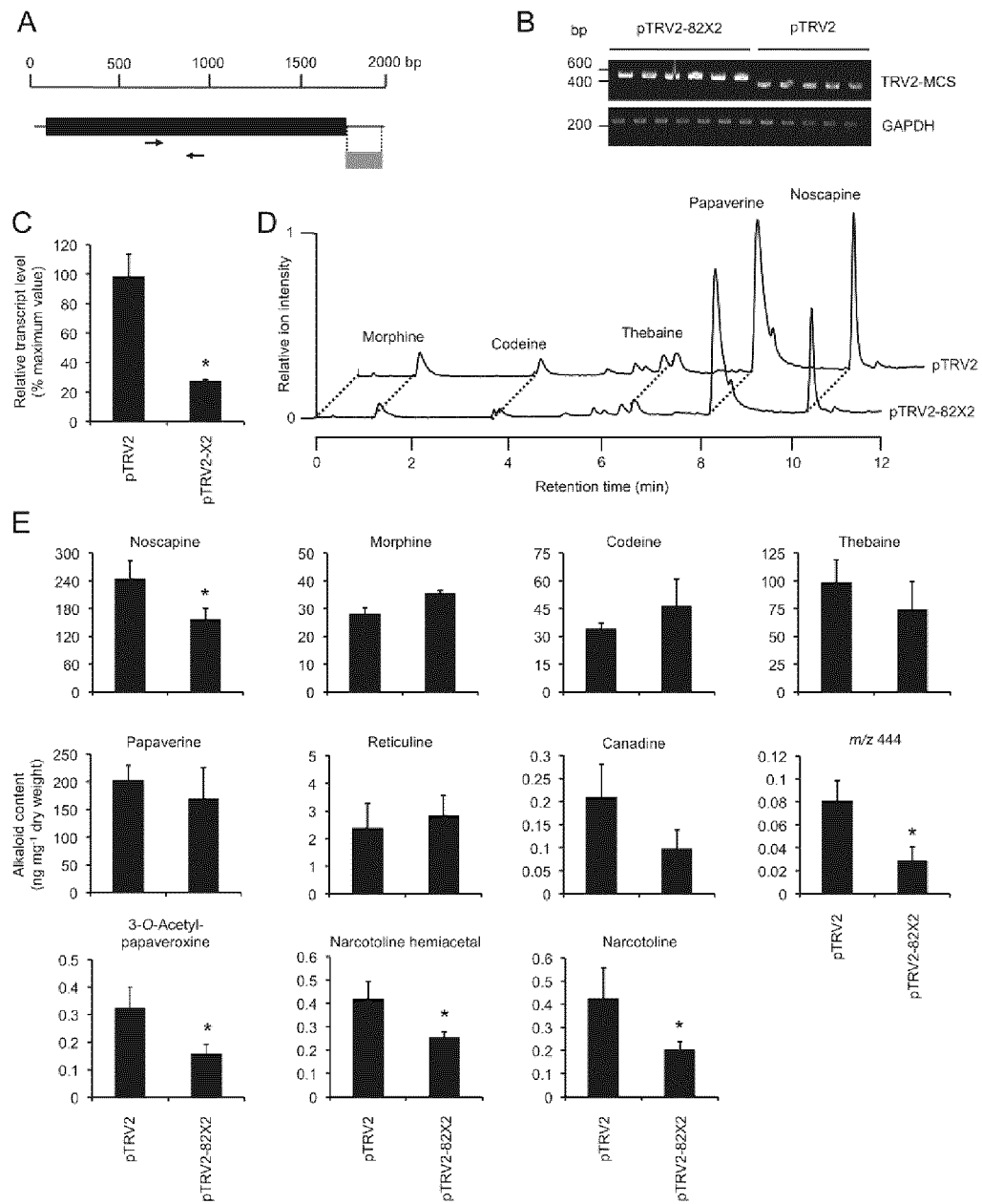
FIG. 18 shows certain data relating to the gene silencing of CYP82X2. Shown are: a fragment (grey box) of the CYP82X2 cDNA used to assemble the pTRV2 construct (FIG. 18A). Ethidium bromide-stained agarose gels showing the detection of the pTRV2 vector by RT-PCR (FIG. 18B). Relative CYP82X2 transcript abundance in control (pTRV2) and CYP82X2-silenced (pTRV2-82X2) plants (FIG. 18C). Total ion chromatograms showing the major alkaloid profiles of control (pTRV2) and CYP82X2-silenced (pTRV2-82X2) plants (FIG. 18D). Relative abundance of major noted latex alkaloids, and other noted alkaloids showing suppressed levels in CYP82X2-silenced (pTRV2-82X2) plants compared with controls (pTRV2) (FIG. 18 E).

CYP82X2 expression was suppressed as described in Example 22 and secondary metabolites were analyzed as described in the same. Shown in FIG. 18 are: (A) a fragment (grey box) of the CYP82X2 cDNA used to assemble the pTRV2 construct. The black box represents the coding region, whereas the black lines are the flanking untranslated regions. Arrows show the annealing sites of primers used for qRT-PCR analysis (FIG. 18A). (B) Ethidium bromide-stained agarose gels showing the detection of the pTRV2 vector by RT-PCR using total RNA extracted from individual plants infiltrated with *Agrobacterium tumefaciens* harboring the pTRV2-82X2 construct or the pTRV2 empty vector control. PCR primers (TRV2-MCS) were designed to anneal to regions flanking the multiple cloning site (MCS) of pTRV2 (FIG. 18B). (C) Relative CYP82X2 transcript abundance in control (pTRV2) and CYP82X2-silenced (pTRV2-82X2) plants (FIG. 18C). (D) Total ion chromatograms showing the major alkaloid profiles of control (pTRV2) and CYP82X2-silenced (pTRV2-82X2) plants (FIG. 18D). (E) Relative abundance of major latex alkaloids, and other alkaloids showing suppressed levels in CYP82X2-silenced (pTRV2-82X2) plants compared with controls (pTRV2) (FIG. 18E). The results show that, in addition to lower noscapine content, silencing of CYP82X2 causes significant reduction in the levels of several noscapine pathway intermediates, but does not affect the relative abundance of major alkaloids. Asterisks represent significant differences determined using an unpaired, two-tailed Student t test ($p<0.05$) Furthermore the data provided in this Example 23 are consistent with an accumulation of upstream noscapine pathway intermediates as a result of CYP82X2 gene silencing.

Example 24

Figure 19:
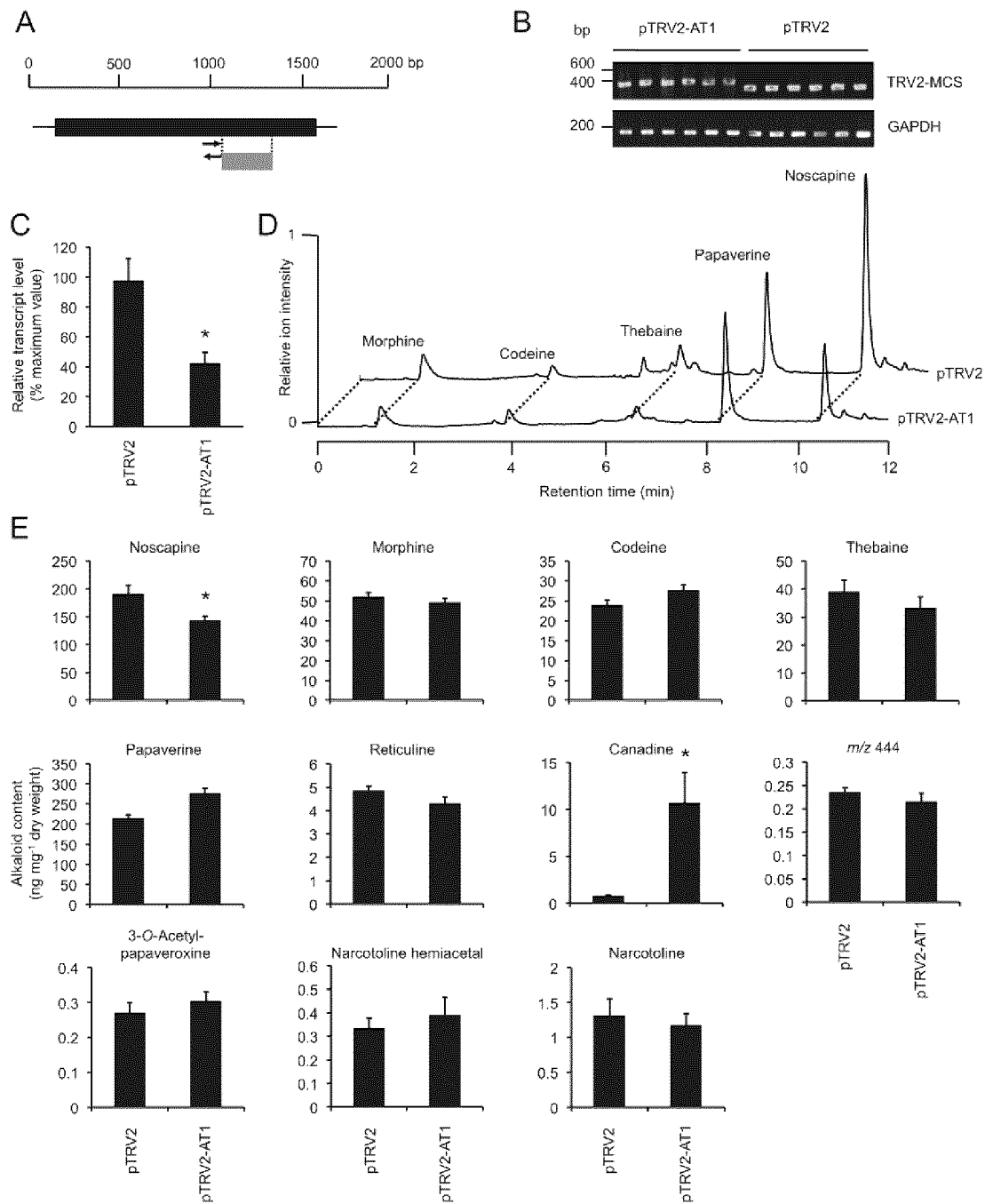
FIG. 19 shows certain data relating to the gene silencing of AT1. Shown are: a fragment (grey box) of the AT1 cDNA used to assemble the pTRV2 construct (FIG. 19 A). Ethidium bromide-stained agarose gels showing the detection of the pTRV2 vector by RT-PCR (FIG. 19B). Relative AT1 transcript abundance in control (pTRV2) and AT1-silenced (pTRV2-AT1) plants (FIG. 19C). (D) Total ion chromatograms showing the major alkaloid profiles of control (pTRV2) and AT1-silenced (pTRV2-AT1) plants (FIG. 19D). Relative abundance of major latex alkaloids, and other alkaloids showing suppressed levels in AT1-silenced (pTRV2-AT1) plants compared with controls (pTRV2) (FIG. 19 E).

Suppression of AT1, In-Vivo Production of Noscapine Pathway Metabolites of 1,13-Dihydroxy-N-Methylcanadine AT1 expression was suppressed as described in Example 22 and secondary metabolites were analyzed as described in the same. Shown in FIG. 19 are: (A) a fragment (grey box) of the AT1 cDNA used to assemble the pTRV2 construct. The black box represents the coding region, whereas the black lines are the flanking untranslated regions. Arrows show the annealing sites of primers used for qRT-PCR analysis (FIG. 19A). (B) Ethidium bromide-stained agarose gels showing the detection of the pTRV2 vector by RT-PCR using total RNA extracted from individual plants infiltrated with Agrobacterium tumefaciens harboring the pTRV2-AT1 construct or the pTRV2 empty vector control. PCR primers (TRV2-MCS) were designed to anneal to regions flanking the multiple cloning site (MCS) of pTRV2 (FIG. 19B). (C) Relative AT1 transcript abundance in control (pTRV2) and AT1-silenced (pTRV2-AT1) plants (FIG. 19C). (D) Total ion chromatograms showing the major alkaloid profiles of control (pTRV2) and AT1-silenced (pTRV2-AT1) plants (FIG. 19D). (E) Relative abundance of major latex alkaloids, and other alkaloids showing suppressed levels in AT1-silenced (pTRV2-AT1) plants compared with controls (pTRV2) (FIG. 19E). The results show that in addition to lower noscapine content, silencing of AT1 causes a significant increase in the accumulation of canadine, but does not affect the relative abundance of major alkaloids. The AT1 substrate, (S)-1,13-dihydroxy-N-methylcanadine was not detected in control (pTRV2) and AT1-silenced (pTRV2-AT1) plants. Asterisks represent significant differences determined using an unpaired, two-tailed Student t test (p<0.05).

Example 25

Figure 20:
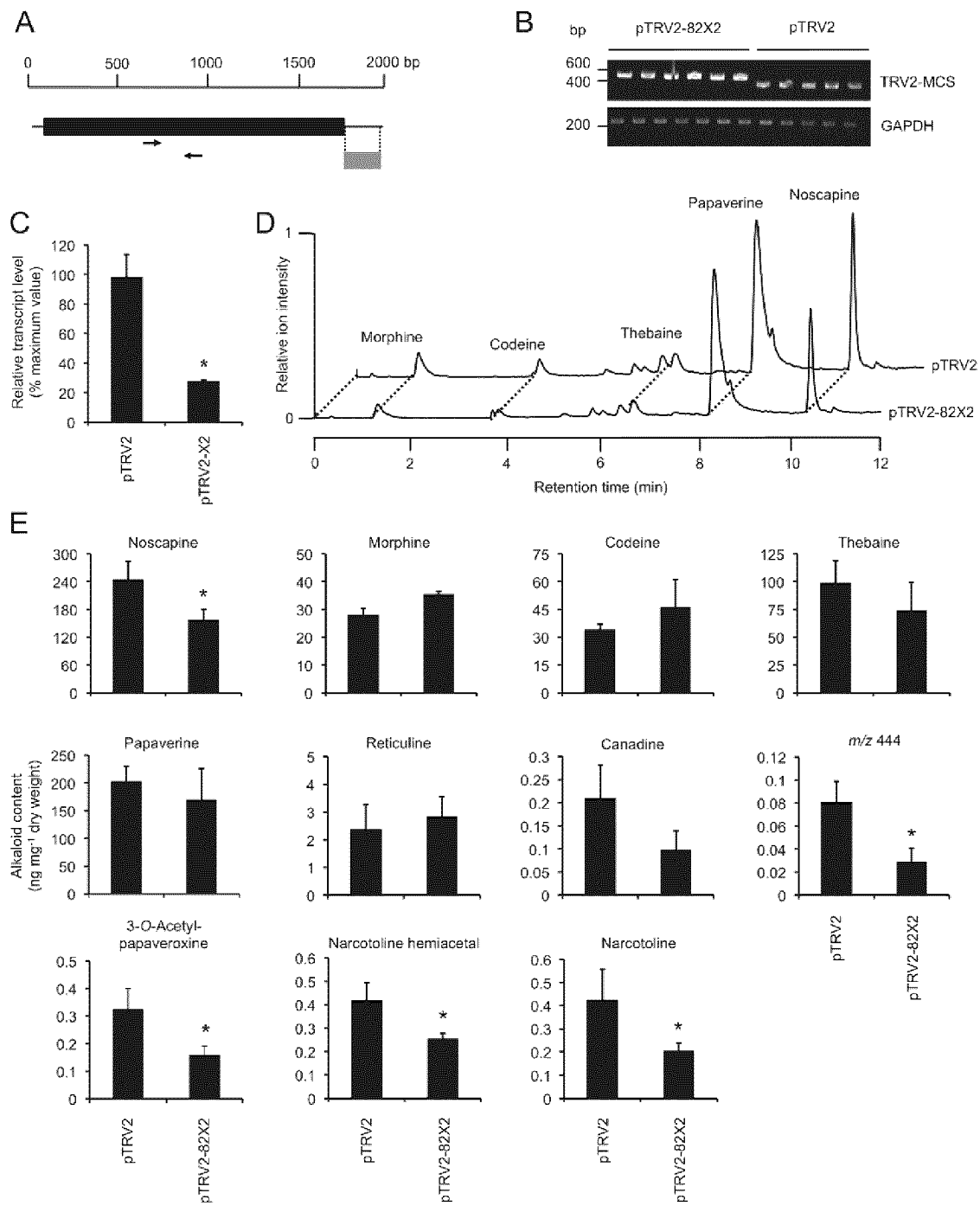
FIG. 20 shows certain data relating to the gene silencing of CYP82X1. Shown are: a fragment (grey box) of the CYP82X1 cDNA used to assemble the pTRV2 construct (FIG. 20 A). Ethidium bromide-stained agarose gels showing the detection of the pTRV2 vector by RT-PCR (FIG. 20 B). Relative CYP82X1 transcript abundance in control (pTRV2) and CYP82X1-silenced (pTRV2-82X1) plants (FIG. 20 C). Total ion chromatograms showing the major alkaloid profiles of control (pTRV2) and CYP82X1-silenced (pTRV2-82X1) plants (FIG. 20 D). Relative abundance of major latex alkaloids, and other alkaloids showing suppressed levels in CYP82X1-silenced (pTRV2-82X1) plants compared with controls (pTRV2) (FIG. 20 E).

Suppression of CYP82X1, In-Vivo Production of 1-Hydroxy-13-O-Acetyl-N-Methylcanadine and Upstream Metabolites CYP82X1 expression was suppressed as described in Example 22 and secondary metabolites were analyzed as described in the same. Shown in FIG. 20 are: (A) a fragment (grey box) of the CYP82X1 cDNA used to assemble the pTRV2 construct. The black box represents the coding region, whereas the black lines are the flanking untranslated regions. Arrows show the annealing sites of primers used for qRT-PCR analysis (FIG. 20A). (B) Ethidium bromide-stained agarose gels showing the detection of the pTRV2 vector by RT-PCR using total RNA extracted from individual plants infiltrated with Agrobacterium tumefaciens harboring the pTRV2-82X1 construct or the pTRV2 empty vector control. PCR primers (TRV2-MCS) were designed to anneal to regions flanking the multiple cloning site (MCS) of pTRV2 (FIG. 20B). (C) Relative CYP82X1 transcript abundance in control (pTRV2) and CYP82X1-silenced (pTRV2-82X1) plants (FIG. 20 C). (D) Total ion chromatograms showing the major alkaloid profiles of control (pTRV2) and CYP82X1-silenced (pTRV2-82X1) plants (FIG. 20D). (E) Relative abundance of major latex alkaloids, and other alkaloids showing suppressed levels in CYP82X1-silenced (pTRV2-82X1) plants compared with controls (pTRV2) (FIG. 20E). The results show that in addition to lower noscapine content, silencing of CYP82X1 causes significant reduction in the levels of several noscapine pathway intermediates, but does not affect the relative abundance of major alkaloids. Asterisks represent significant differences determined using an unpaired, two-tailed Student t test (p<0.05). Furthermore the data provided in this Example 25 are consistent with accumulation of 1-hydroxy-13-O-acetyl-N-methylcanadine and upstream metabolites as a result of the gene silencing.

Example 26

Figure 21:
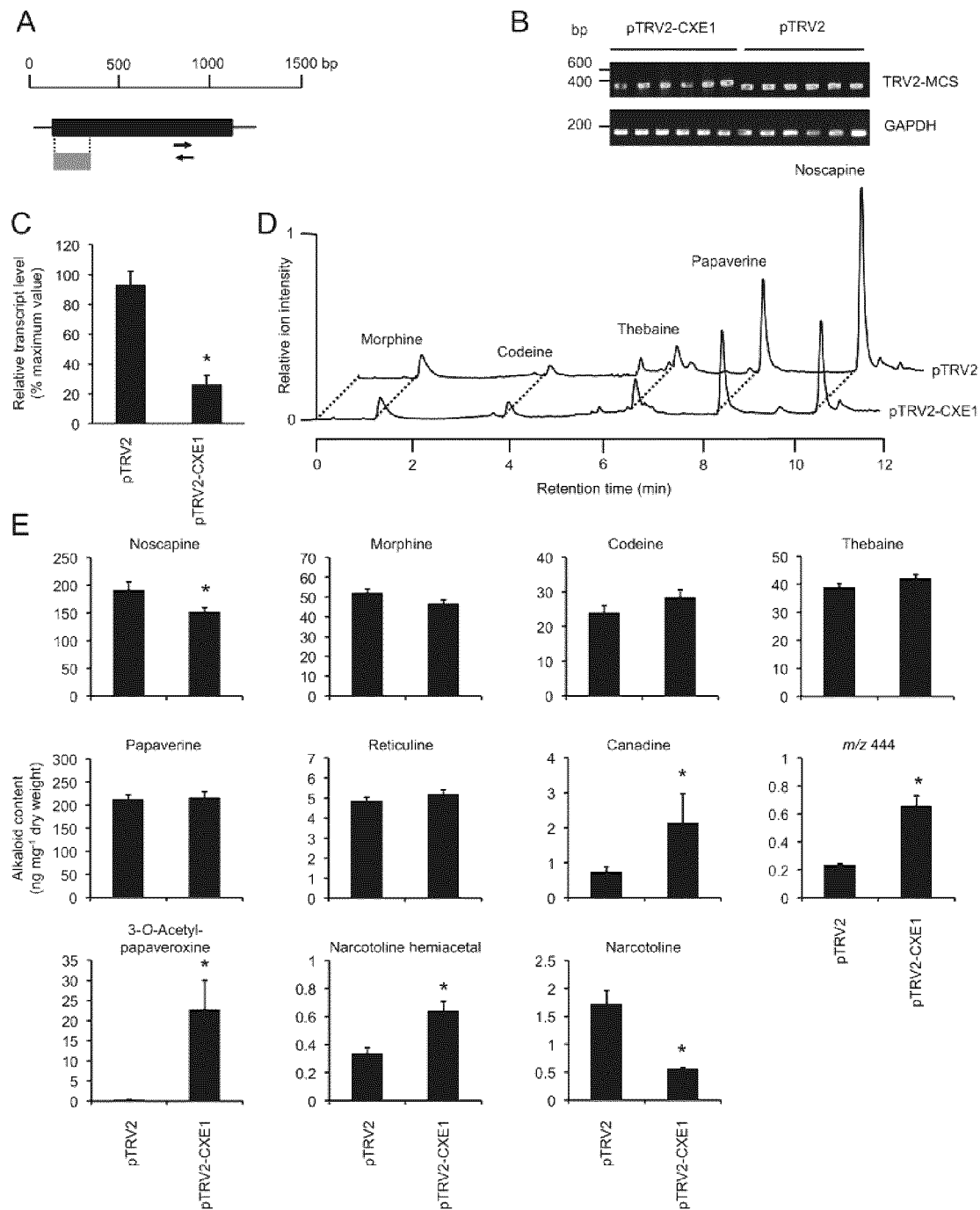
FIG. 21 shows certain data relating to the gene silencing of CXE1. Shown are: a fragment (grey box) of the CXE1 cDNA used to assemble the pTRV2 construct (FIG. 21A). Ethidium bromide-stained agarose gels showing the detection of the pTRV2 vector by RT-PCR (FIG. 21B) Relative CXE1 transcript abundance in control (pTRV2) and CXE1-silenced (pTRV2-CXE1) plants (FIG. 21C). Total ion chromatograms showing the major alkaloid profiles of control (pTRV2) and CXE1-silenced (pTRV2-CXE1) plants (FIG. 21D). Relative abundance of major latex alkaloids, and other alkaloids showing suppressed levels in CXE1-silenced (pTRV2-CXE1) plants compared with controls (pTRV2) (FIG. 21E).

Suppression of CXE1, In-Vivo Production of Noscapine Pathway Metabolites Upstream of 3-O-Acetylpapaveroxine and Metabolites Upstream CXE1 expression was suppressed as described in Example 22 and secondary metabolites were analyzed as described in the same. Shown in FIG. 21 are: (A) a fragment (grey box) of the CXE1 cDNA used to assemble the pTRV2 construct. The black box represents the coding region, whereas the black lines are the flanking untranslated regions. Arrows show the annealing sites of primers used for qRT-PCR analysis (FIG. 21 A). (B) Ethidium bromide-stained agarose gels showing the detection of the pTRV2 vector by RT-PCR using total RNA extracted from individual plants infiltrated with Agrobacterium tumefaciens harboring the pTRV2-CXE1 construct or the pTRV2 empty vector control. PCR primers (TRV2-MCS) were designed to anneal to regions flanking the multiple cloning site (MCS) of pTRV2 (FIG. 21 B). (C) Relative CXE1 transcript abundance in control (pTRV2) and CXE1-silenced (pTRV2-CXE1) plants (FIG. 21 C). (D) Total ion chromatograms showing the major alkaloid profiles of control (pTRV2) and CXE1-silenced (pTRV2-CXE1) plants (FIG. 21 D). (E) Relative abundance of major latex alkaloids, and other alkaloids showing suppressed levels in CXE1-silenced (pTRV2-CXE1) plants compared with controls (pTRV2) (FIG. 21 E). The results show, in addition to lower noscapine content, silencing of CXE1 causes a significant increase in the accumulation of several noscapine pathway intermediates, but did not affect the relative abundance of major alkaloids. The increased accumulation of narcotine hemiacetal in CXE1-silenced (pTRV2-CXE1) versus control (pTRV2) plants is likely an artifact caused by non-enzymatic hydrolysis of the acetyl ester of 3-O-acetylpapaveroxine during methanol extraction of latex alkaloids. Asterisks represent significant differences determined using an unpaired, two-tailed Student t test (p<0.05). Furthermore the data provided in this Example 26 are consistent with accumulation of 3-O-acetylpapaveroxine and upstream metabolites as a result of the gene silencing.

While the present invention has been described with reference to what are presently considered to be the preferred examples, it is to be understood that the invention is not limited to the disclosed examples. To the contrary, the invention is intended to cover various modifications and equivalent arrangements included within the spirit and scope of the appended claims.

TABLE A
| | Noscapine | | | | | | |
|---|---|---|---|---|---|---|---|
| | CYP82Y1 | CYP82X2 | AT1 | CYP82X1 | OMT | CXE1 | NOS (SDR1) |
| 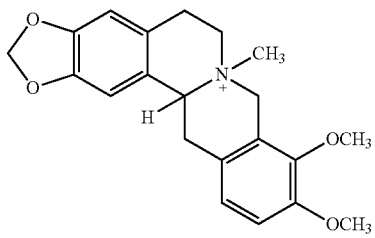 (S)-N-methylcanadine | ✓ | ✓ | ✓ | ✓ | ✓ | ✓ | ✓ |
| 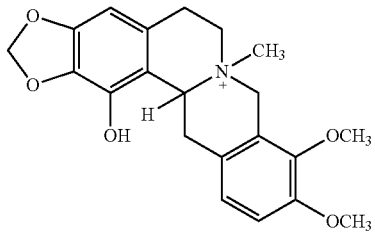 1-hydroxy-N-methylcanadine | | ✓ | ✓ | ✓ | ✓ | ✓ | ✓ |
| 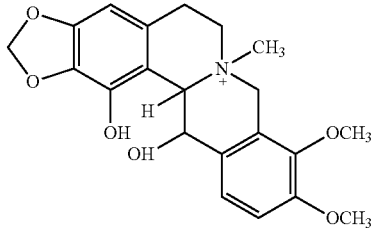 1,13-dihydroxy-N-methylcanadine | | | ✓ | ✓ | ✓ | ✓ | ✓ |
| 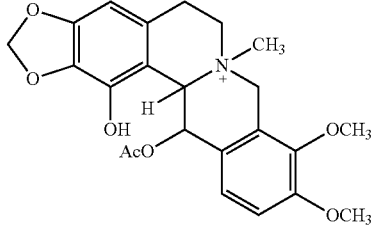 1-hydroxy-13-O-acetyl-N-methylcanadine | | | | ✓ | ✓ | ✓ | ✓ |
| 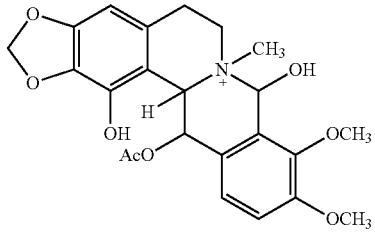 1,8-dihydroxy-13-O-acetyl-N-methylcanadine | | | | | ✓ | ✓ | ✓ |

TABLE A-continued
| | Noscapine | | | | | | | |
|---|---|---|---|---|---|---|---|---|
| | CYP82Y1 | CYP82X2 | AT1 | CYP82X1 | OMT | CXE1 | NOS (SDR1) |
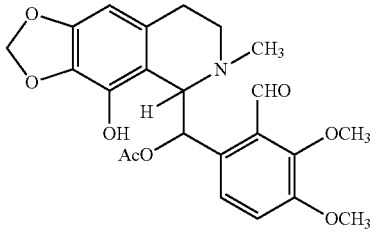
4'-O-desmethyl-3-O-acetyl-papaveroxine: OMT ✓, CXE1 ✓, NOS ✓
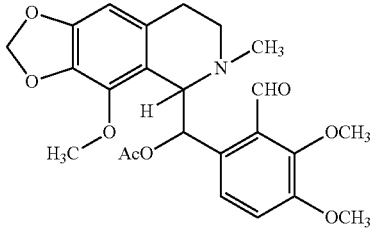
3-O-acetyl-papaveroxine: CXE1 ✓, NOS ✓
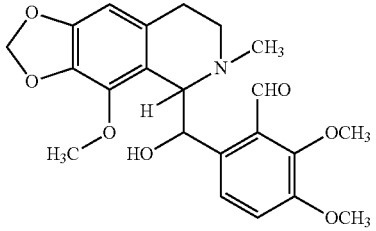
Papaveroxine: NOS ✓
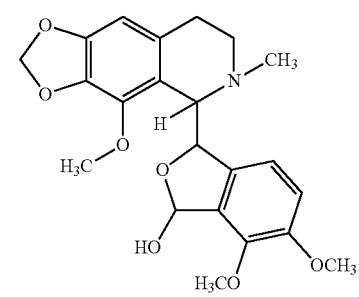
Narcotine hemiacetal: NOS ✓

TABLE B
| | Narcotinohemiacetal | | | | | |
|---|---|---|---|---|---|---|
| | CYP82Y1 | CYP82X2 | AT1 | CYP82X1 | OMT | CXE1 |
| 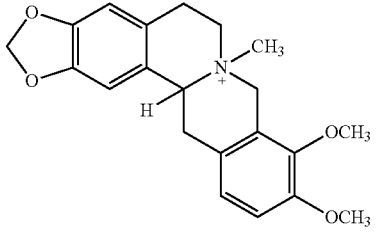 (S)-N-methylcanadine | ✓ | ✓ | ✓ | ✓ | ✓ | ✓ |
| 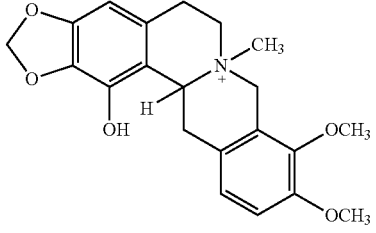 1-hydroxy-N-methylcanadine | | ✓ | ✓ | ✓ | ✓ | ✓ |
| 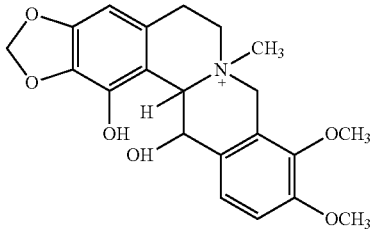 1,13-dihydroxy-N-methylcanadine | | | ✓ | ✓ | ✓ | ✓ |
| 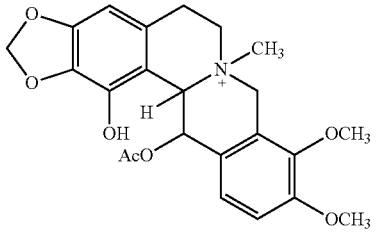 1-hydroxy-13-O-acetyl-N-methylcanadine | | | | ✓ | ✓ | ✓ |
| 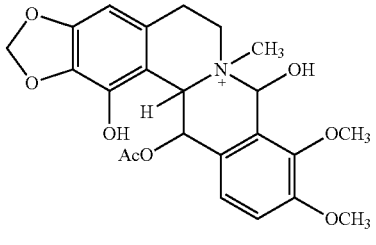 1,8-dihydroxy-13-O-acetyl-N-methylcanadine | | | | | ✓ | ✓ |

TABLE B-continued

| Narcotinohemiacetal | | | | | | |
|---|---|---|---|---|---|---|
| | CYP82Y1 | CYP82X2 | AT1 | CYP82X1 | OMT | CXE1 |
| 4'-O-desmethyl-3-O-acetyl-papaveroxine | | | | | ✓ | ✓ |
| 3-O-acetyl-papaveroxine | | | | | | ✓ |
| Papaveroxine | | | | | | |

TABLE C

| Papaveroxine | | | | | | |
|---|---|---|---|---|---|---|
| | CYP82Y1 | CYP82X2 | AT1 | CYP82X1 | OMT | CXE1 |
| (S)-N-methylcanadine | ✓ | ✓ | ✓ | ✓ | ✓ | ✓ |

TABLE C-continued
| | Papaveroxine | | | | | |
|---|---|---|---|---|---|---|
| | CYP82Y1 | CYP82X2 | AT1 | CYP82X1 | OMT | CXE1 |
| 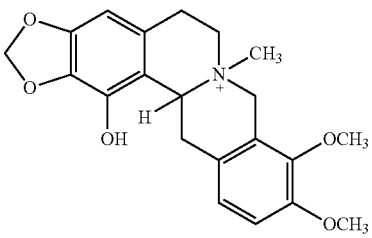 1-hydroxy-N-methylcanadine | | ✓ | ✓ | ✓ | ✓ | ✓ |
| 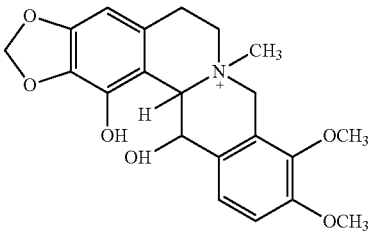 1,13-dihydroxy-N-methylcanadine | | | ✓ | ✓ | ✓ | ✓ |
| 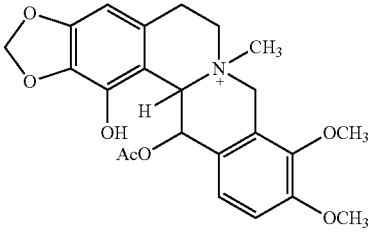 1-hydroxy-13-O-acetyl-N-methylcanadine | | | | ✓ | ✓ | ✓ |
| 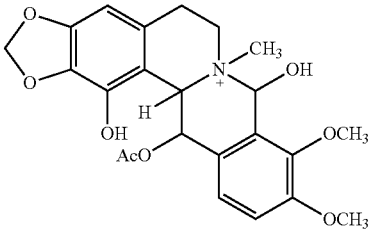 1,8-dihydroxy-13-O-acetyl-N-methylcanadine | | | | | ✓ | ✓ |
| 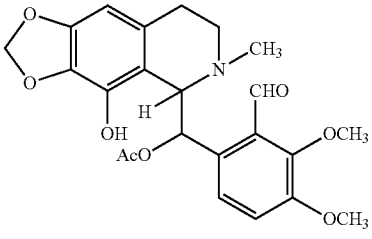 4′-O-desmethyl-3-O-acetyl-papaveroxine | | | | | ✓ | ✓ |

TABLE C-continued

Papaveroxine

| | CYP82Y1 | CYP82X2 | AT1 | CYP82X1 | OMT | CXE1 |
|---|---|---|---|---|---|---|
| 3-O-acetyl-papaveroxine | | | | | | ✓ |

TABLE D

3-O-acetyl-papaveroxine

| | CYP82Y1 | CYP82X2 | AT1 | CYP82X1 | OMT |
|---|---|---|---|---|---|
| (S)-N-methylcanadine | ✓ | ✓ | ✓ | ✓ | ✓ |
| 1-hydroxy-N-methylcanadine | | ✓ | ✓ | ✓ | ✓ |
| 1,13-dihydroxy-N-methylcanadine | | | ✓ | ✓ | ✓ |

TABLE D-continued

3-O-acetyl-papaveroxine

| | CYP82Y1 | CYP82X2 | AT1 | CYP82X1 | OMT |
|---|---|---|---|---|---|
| 1-hydroxy-13-O-acetyl-N-methylcanadine | | | | ✓ | ✓ |
| 1,8-dihydroxy-13-O-acetyl-N-methylcanadine | | | | ✓ | |
| 4'-O-desmethyl-3-O-acetyl-papaveroxine | | | | ✓ | |

TABLE E

4'-O-desmethyl-3-O-acetyl-papaveroxine

| | CYP82Y1 | CYP82X2 | AT1 | CYP82X1 |
|---|---|---|---|---|
| (S)-N-methylcanadine | ✓ | ✓ | ✓ | ✓ |

TABLE E-continued

| 4'-O-desmethyl-3-O-acetyl-papaveroxine | | | | |
|---|---|---|---|---|
| | CYP82Y1 | CYP82X2 | AT1 | CYP82X1 |
| 1-hydroxy-N-methylcanadine | | ✓ | ✓ | ✓ |
| 1,13-dihydroxy-N-methylcanadine | | | ✓ | ✓ |
| 1-hydroxy-13-O-acetyl-N-methylcanadine | | | | ✓ |
| 1,8-dihydroxy-13-O-acetyl-N-methylcanadine | | | | |

TABLE F

| 1,8-dihydroxy-13-O-acetyl-N-methylcanadine | | | | |
|---|---|---|---|---|
| | CYP82Y1 | CYP82X2 | AT1 | CYP82X1 |
| (S)-N-methylcanadine | ✓ | ✓ | ✓ | ✓ |

TABLE F-continued
1,8-dihydroxy-13-O-acetyl-N-methylcanadine
| | CYP82Y1 | CYP82X2 | AT1 | CYP82X1 |
|---|---|---|---|---|
| 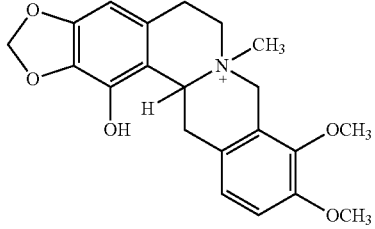 1-hydroxy-N-methylcanadine | | ✓ | ✓ | ✓ |
| 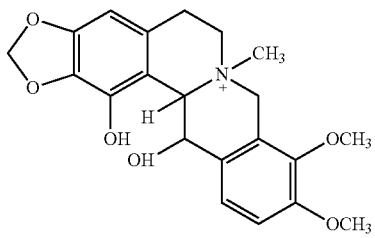 1,13-dihydroxy-N-methylcanadine | | ✓ | ✓ | |
| 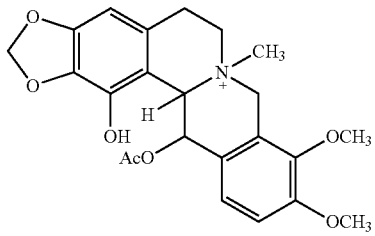 1-hydroxy-13-O-acetyl-N-methylcanadine | | | ✓ | |
TABLE G
1-hydroxy-13-O-acetyl-N-methylcanadine
| | CYP82Y1 | CYP82X2 | AT1 |
|---|---|---|---|
| 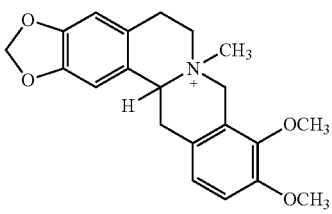 (S)-N-methylcanadine | ✓ | ✓ | ✓ |
TABLE G-continued
1-hydroxy-13-O-acetyl-N-methylcanadine
| | CYP82Y1 | CYP82X2 | AT1 |
|---|---|---|---|
| 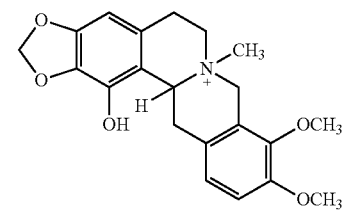 1-hydroxy-N-methylcanadine | | ✓ | ✓ |

TABLE G-continued 1-hydroxy-13-O-acetyl-N-methylcanadine

| | CYP82Y1 | CYP82X2 | AT1 |
|---|---|---|---|
| 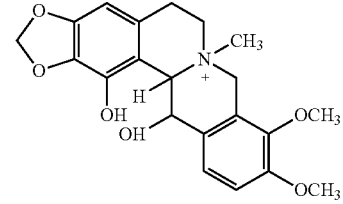 1,13-dihydroxy-N-methylcanadine | | | ✓ |

TABLE H 1,13-dihydroxy-N-methylcanadine

| | CYP82Y1 | CYP82X2 |
|---|---|---|
| 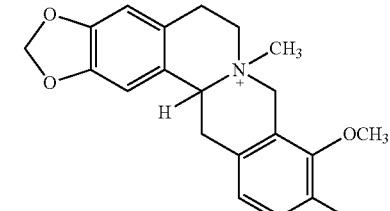 (S)-N-methylcanadine | ✓ | ✓ |

TABLE H-continued 1,13-dihydroxy-N-methylcanadine

| | CYP82Y1 | CYP82X2 |
|---|---|---|
| 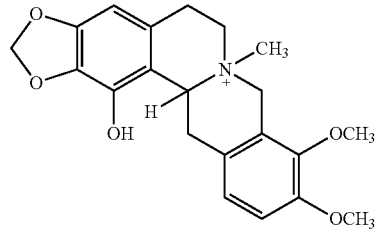 1-hydroxy-N-methylcanadine | | ✓ |

TABLE I 1-hydroxy-N-methylcanadine

| | CYP82Y1 |
|---|---|
| 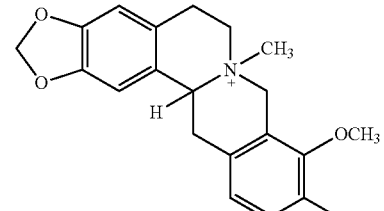 (S)-N-methylcanadine | ✓ |

TABLE J narcotoline hemiacetal

| | CYP82Y1 | CYP82X2 | AT1 | CYP82X2 | CXE1 (OPTIONAL) |
|---|---|---|---|---|---|
| 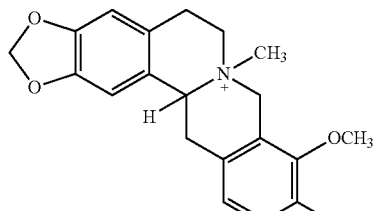 (S)-N-methylcanadine | ✓ | ✓ | ✓ | ✓ | ✓ |
| 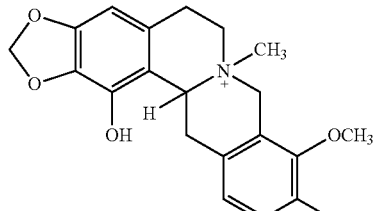 1-hydroxy-N-methylcanadine | | ✓ | ✓ | ✓ | ✓ |

TABLE J-continued narcotoline hemiacetal

| | CYP82Y1 | CYP82X2 | AT1 | CYP82X2 | CXE1 (OPTIONAL) |
|---|---|---|---|---|---|
| 1,13-dihydroxy-N-methylcanadine | | | ✓ | ✓ | ✓ |
| 1-hydroxy-13-O-acetyl-N-methylcanadine | | | | ✓ | ✓ |
| 1,8-dihydroxy-13-O-acetyl-N-methylcanadine | | | | | ✓ |
| 4'-O-desmethyl-3-O-acetyl-papaveroxine | | | | | ✓ |

TABLE K

Narcotoline

| | CYP82Y1 | CYP82X2 | AT1 | CYP82X1 | NOS (SDR1) | CXE1 (OPTIONAL) |
|---|---|---|---|---|---|---|
| (S)-N-methylcanadine | ✓ | ✓ | ✓ | ✓ | ✓ | ✓ |

TABLE K-continued
| | Narcotoline | | | | | |
|---|---|---|---|---|---|---|
| | CYP82Y1 | CYP82X2 | AT1 | CYP82X1 | NOS (SDR1) | CXE1 (OPTIONAL) |
| 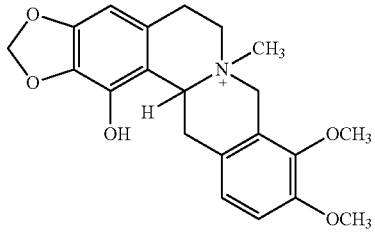 1-hydroxy-N-methylcanadine | | ✓ | ✓ | ✓ | ✓ | ✓ |
| 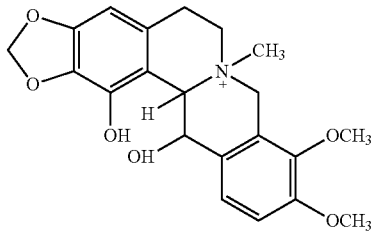 1,13-dihydroxy-N-methylcanadine | | | ✓ | ✓ | ✓ | ✓ |
| 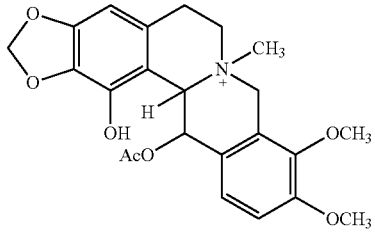 1-hydroxy-13-O-acetyl-N-methylcanadine | | | | ✓ | ✓ | ✓ |
| 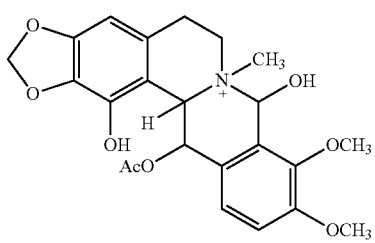 1,8-dihydroxy-13-O-acetyl-N-methylcanadine | | | | | ✓ | ✓ |
| 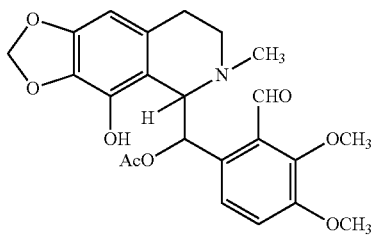 4'-O-desmethyl-3-O-acetyl-papaveroxine | | | | | ✓ | ✓ |

TABLE K-continued

Narcotoline

| | CYP82Y1 | CYP82X2 | AT1 | CYP82X1 | NOS (SDR1) | CXE1 (OPTIONAL) |
|---|---|---|---|---|---|---|
| 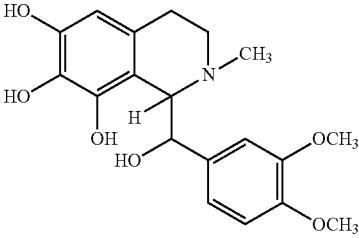 4'-desmethoxy-papaveroxine | | | | ✓ | | |
| 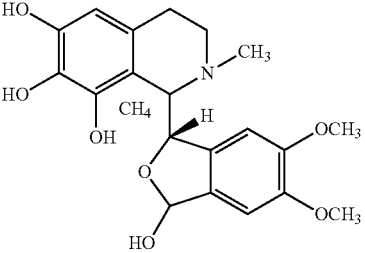 Narcotoline hemiacetal | | | | ✓ | | |

TABLE L

| Nucleic Acid | SEQ. ID NO |
|---|---|
| *Papaver somniferum* | |
| CYP82Y1 | 1 |
| CYP82X2 | 3 |
| AT1 | 5, 19, 248 |
| CYP82X1 | 7 |
| OMT | 9, 17, 516, 518, 520, 522, 524, 526, 528, 530, 532, 534, 536, 538, 540, 542, 544, 546, 548, 550, 552, 554, 556, 558 |
| CXE 1 | 11, 307 |
| CXE 2 | 15, 308 |
| NOS | 13 |
| *Cissampelos mucronata* | |
| CYP82 | 39, 40, 41 |
| AT | 232 |
| CXE | 284, 285 |
| OMT | 442, 443 |
| NOS | |
| *Eschscholzia californica* | |
| CYP82 | 42, 43, 44, 45, 46, 47, 48, 49, 50 |
| AT | 234 |
| CXE | 287 |
| OMT | 446, 447 |
| NOS | 367 |
| *Jeffersonia diphylla* | |
| CYP82 | 69, 70 |
| AT | 238 |
| CXE | 292 |
| OMT | 452, 453 |
| NOS | 375, 376, 377 |
| *Nandina domestica* | |
| CYP82 | 78, 79, 80 |
| AT | 241 |
| CXE | 297, 298 |
| OMT | 458, 459 |
| NOS | 380, 381 |
| *Sanguinaria canadensis* | |
| CYP82 | 95, 96, 97, 98, 99, 100, 101, 102, 103, 104, 105, 106 |
| AT | 249 |
| CXE | 309, 310 |
| OMT | 464, 465 |
| NOS | 384, 385, 386, 387 |
| *Tinospora cordifolia* | |
| CYP82 | 113, 114, 115, 116 |
| AT | 252 |
| CXE | 312, 313, 314 |
| OMT | 468, 469 |
| NOS | |
| *Papaver bracteatum* | |
| CYP82Y1 | 88 |
| CYP82 | 89, 91, 92, 93, 94 |
| AT | 243, 244, 245, 246, 247 |
| CYP82X1 | 90 |
| OMT | 462, 463, 559, 560, 561, 562, 563, 564, 565, 566, 567, 568, 569, 570, 571, 572, 573, 574, 575, 576, 577, 578 |
| CXE | 304, 305, 306 |
| NOS | |
| *Cocculus trilobus* | |
| CYP82 | |
| AT | 233 |
| CXE | 286 |
| OMT | 444, 445 |
| NOS | |

TABLE L-continued

| Nucleic Acid | SEQ. ID NO |
|---|---|
| *Glaucium flavum* | |
| CYP82 | 51, 52, 53, 54, 55, 56, 57, 58 |
| AT | 235, 236 |
| CXE | 288 |
| OMT | 448, 449 |
| NOS | 368, 369, 370, 371 |
| *Mahonia aquifolium* | |
| CYP82 | 71, 72 |
| AT | 239 |
| CXE | 293 |
| OMT | 454, 455 |
| NOS | |
| *Nigella sativa* | |
| CYP82 | 81, 82, 83, 84, 85, 86, 87 |
| AT | 242 |
| CXE | 299, 300, 301, 302, 303 |
| OMT | 460, 461 |
| NOS | 382, 430, 383 |
| *Stylophorum diphyllum* | |
| CYP82 | 107, 108, 109, 110, 111, 112, |
| AT | 250, 251 |
| CXE | 311 |
| OMT | 466, 467 |
| NOS | 388, 389, 390 |
| *Xanthoriza simplicissima* | |
| CYP82 | 118, 119, 120, 121, 122, 123 |
| AT | 254 |
| CXE | 316, 317, 318 |
| OMT | 472, 473 |
| NOS | |
| *Chelidonium majus* | |
| CYP82 | 33, 34, 35, 36, 37, 38 |
| AT | 229, 230, 231 |
| CXE | 283 |
| OMT | 440, 441 |
| NOS | 364, 365, 366 |
| *Chordyalis chelanthifolia* | |
| CYP82 | 25, 26, 27, 28, 29, 30, 31, 32 |
| AT | 228 |
| CXE | |
| OMT | 438, 439 |
| NOS | 358, 359, 360, 361, 362, 363 |
| *Hydrastis canadensis* | |
| CYP82 | 59, 60, 61, 62, 63, 64, 65, 66, 67, 68 |
| AT | 237 |
| CXE | 289, 290, 291 |
| OMT | 450, 451 |
| NOS | 372, 373, 374 |
| *Menispermum canadense* | |
| CYP82 | 73, 74, 75, 76, 77 |
| AT | 240 |
| CXE | 294, 295, 296 |
| OMT | 456, 457 |
| NOS | 378, 379 |
| *Berberis thunbergii* | |
| CYP82 | 23, 126 |
| AT | 227 |
| CXE | 282 |
| OMT | 436, 437 |
| NOS | 355, 356, 357 |

TABLE L-continued

| Nucleic Acid | SEQ. ID NO |
|---|---|
| *Thalictrum flavum* | |
| CYP82 | 117 |
| AT | 253 |
| CXE | 315 |
| OMT | 470, 471 |
| NOS | |
| *Argemone mexicana* | |
| CYP82 | 21, 22 |
| AT | 514 |
| CXE | 281 |
| OMT | 434, 435 |
| NOS | 353, 354 |

TABLE M

| Protein | SEQ. ID NO |
|---|---|
| *Papaver somniferum* | |
| CYP82Y1 | 2 |
| CYP82X2 | 4 |
| AT1 | 6, 20, 431 |
| CYP82X1 | 8 |
| OMT | 10, 18, 515, 517, 519, 521, 523, 525, 527, 529, 531, 533, 535, 537, 539, 541, 543, 545, 547, 549, 551, 553, 555, 557 |
| CXE 1 | 12, 432 |
| CXE 2 | 16, 433 |
| NOS | 14 |
| *Cissampelos mucronata* | |
| CYP82 | 142, 143, 144 |
| AT | 261 |
| CXE | 322, 323 |
| OMT | 482, 483 |
| NOS | |
| *Eschscholzia californica* | |
| CYP82 | 145, 146, 147, 148, 149, 150, 151, 152, 153 |
| AT | 263 |
| CXE | 325 |
| OMT | 486, 487 |
| NOS | 405 |
| *Jeffersonia diphylla* | |
| CYP82 | 172, 173 |
| AT | 267 |
| CXE | 329 |
| OMT | 492, 493 |
| NOS | 413, 414, 415 |
| *Nandina domestica* | |
| CYP82 | 181, 182, 183 |
| AT | 270 |
| CXE | 333, 334 |
| OMT | 498, 499 |
| NOS | 418, 419 |
| *Sanguinaria canadensis* | |
| CYP82 | 198, 199, 200, 201, 202, 203, 204, 205, 206, 207, 208, 209 |
| AT | 277 |
| CXE | 343, 344 |
| OMT | 504, 505 |
| NOS | 423, 424, 425, 426 |
| *Tinospora cordifolia* | |
| CYP82 | 216, 217, 218, 219 |
| AT | 278 |

TABLE M-continued

| Protein | SEQ. ID NO |
|---|---|
| CXE | 346, 347, 348 |
| OMT | 508, 509 |
| NOS | |
| *Papaver bracteatum* | |
| CYP82Y1 | 191 |
| CYP82 | 192, 194, 195, 196, 197 |
| AT | 272, 273, 274, 275, 276 |
| CYP82X1 | 193 |
| OMT | 502, 503, 579, 580, 581, 582, 583, 584, 585, 586, 587, 588, 589, 590, 591, 592, 593, 594, 595, 596, 597, 598 |
| CXE | 340, 341, 342 |
| NOS | |
| *Cocculus trilobus* | |
| CYP82 | |
| AT | 262 |
| CXE | 324 |
| OMT | 484, 485 |
| NOS | |
| *Glaucium flavum* | |
| CYP82 | 154, 155, 156, 157, 158, 159, 160, 161 |
| AT | 264, 265 |
| CXE | 326 |
| OMT | 488, 489 |
| NOS | 406, 407, 408, 409 |
| *Mahonia aquifolium* | |
| CYP82 | 174, 175 |
| AT | 268 |
| CXE | |
| OMT | 494, 495 |
| NOS | |
| *Nigella sativa* | |
| CYP82 | 184, 185, 186, 187, 188, 189, 190 |
| AT | 271 |
| CXE | 335, 336, 337, 338, 339 |
| OMT | 500, 501 |
| NOS | 420, 421, 422 |
| *Stylophorum diphyllum* | |
| CYP82 | 210, 211, 212, 213, 214, 215 |
| AT | |
| CXE | 345 |
| OMT | 506, 507 |
| NOS | 427, 428, 429 |
| *Xanthoriza simplicissima* | |
| CYP82 | 221, 222, 223, 224, 225, 226 |
| AT | 280 |
| CXE | 350, 351, 352 |
| OMT | 512, 513 |
| NOS | |
| *Chelidonium majus* | |
| CYP82 | 136, 137, 138, 139, 140, 141 |
| AT | 258, 259, 260 |
| CXE | 321 |
| OMT | 480, 481 |
| NOS | 402, 403, 404 |
| *Chordyalis chelanthifolia* | |
| CYP82 | 128, 129, 130, 131, 132, 133, 134, 135 |
| AT | 228, 257 |
| CXE | |
| OMT | 478, 479 |
| NOS | 396, 397, 398, 399, 400, 401 |
| *Hydrastis canadensis* | |
| CYP82 | 162, 163, 164, 165, 166, 167, 168, 169, 170, 171 |
| AT | 266 |
| CXE | 327, 328 |
| OMT | 490, 491 |
| NOS | 410, 411, 412 |
| *Menispermum canadense* | |
| CYP82 | 176, 177, 178, 179, 180 |
| AT | 269 |
| CXE | 330, 331, 332 |
| OMT | 496, 497 |
| NOS | 416, 417 |
| *Berberis thunbergii* | |
| CYP82 | 24, 127 |
| AT | 256 |
| CXE | 320 |
| OMT | 476, 477 |
| NOS | 393, 394, 395 |
| *Thalictrum flavum* | |
| CYP82 | 220 |
| AT | 279 |
| CXE | 349 |
| OMT | 510, 511 |
| NOS | |
| *Argemone mexicana* | |
| CYP82 | 124, 125 |
| AT | 255 |
| CXE | 319 |
| OMT | 474, 475 |
| NOS | 391, 392 |

SEQUENCE LISTING (610 sequences)

SEQ ID NO: 1 - DNA, 1875 bp, Papaver somniferum
tttcagttcattcatggcgtatttgatgatcaagaagtctatctatttgttttttgatcaaccaactgcagttggcactcttatacttgcttttctgctgacactttcgcctgttattatttactatgaacagaagaagaggggtttgaggcgaaatcgcaccgcaattacaacgactccattaccagaggcatcaggtgcatggccagtgataggtcatcttcttcttttcatgaacgaaaacgatctaaatcatgtaactcttggtcacatggctgataaatatggacctattttcagcttaagattcggtagtcatagaactctagttgttagtagttgggagatggtaaaggagtgttttacaggtaccaatgacaagttgttctcaaatcgtccttcctccttggcggttaaacttatgttttatgacactgaatcttatggttttgcaccttatgggaaatactggagagagttgcgaaagatatctacacacaaactcctctctaatcagcaattagagaagttcaagcacttgcggatttctgaagtcgataactcctttaaaaagcttcatgagttatgcagcaacaacaaacagggaggtgatactacatatgtggctagtcttgtgagaatggatgattggttcgcgtacttgacatttaacgtaataggacggatcgtcagcggattccaatcaaatgcagtggcaggtgccacaaacagccaggaaaaatacaagcttgcaatcgatgaagtgtcaaatcttatggcaacgtttgccgtttcagatgtggttccacggcttgggtggattgatcgattgactggtcttacaggaaagatgaagaattgtggtaaaaaattagatgcagtagttggggatgcagtggaggatcatcgccaaaagaaactcaaaatttctagaaataacacaggagcacttacggagcacgaagaagaagactttatcgatgtttgcttgtcgattatggagcagtcacagattccgggaaaccaccccgaaatctctgtcaaatctattgccttggacatgttatcgggtgggagtgacactacaaaattgataatgacatggaccctttctttgctgttgaaccatccagacatattggacaaggctaaagaagaagtagatacatacttcgggaagaaaaagatatcggataacacacctgtggttgatgctgccgatgttcctaacctcgtctacatccaagcaatcatcaaagaatcaatgcggttataccctgctagcacattgatggagcgaatgacaagtgatgattgtgatgttggtggcttccacgtaccagctgggacacgattatgggttaacgtatggaagatgcaacgggacccaagggtgtggaaagatccactggtatttctacctgagagattcttgagcaatgacaaagggatggtagatgtgaagggtcagaattatgaactgataccatttggaacaggcaggcggatatgtcctggtgcatcttttgccttggaagtcttgcatttggttcttactcgtcttattcttgagttcgagatgaaggcaccagaggggaaaattgacatgagggcaagaccaggttttttccacaacaaggtggtgccactagatgttcaactcaccccacgcacactagattaagattcctatatatgctaattaattagatgaataaaatctgtggtcgagtaaatctaattaatgctaatgaacaagatgaataaaaaattttctttctgcttttgctttggttagggttatttgaccctcatttggttgtattcgttggcgcacaacttttgtgcttcttaatataattccttttggtggat

SEQ ID NO: 2 - protein, 556 aa, Papaver somniferum
MAYLMIKKSIYLFFDQPTAVGTLILAFLLTLSPVIIYYEQKKRGLRRNRTAITTTPLPEASGAWPVIGHLLLFMNENDLNHVTLGHMADKYGPIFSLRFGSHRTLVVSSWEMVKECFTGTNDKLFSNRPSSLAVKLMFYDTESYGFAPYGKYWRELRKISTHKLLSNQQLEKFKHLRISEVDNSFKKLHELCSNNKQGGDTTYVASLVRMDDWFAYLTFNVIGRIVSGFQSNAVAGATNSQEKYKLAIDEVSNLMATFAVSDVVPRLGWIDRLTGLTGKMKNCGKKLDAVVGDAVEDHRQKKLKISRNNTGALTEHEEEDFIDVCLSIMEQSQIPGNHPEISVKSIALDMLSGGSDTTKLIMTWTLSLLLNHPDILDKAKEEVDTYFGKKKISDNTPVVDAADVPNLVYIQAIIKESMRLYPASTLMERMTSDDCDVGGFHVPAGTRLWVNVWKMQRDPRVWKDPLVFLPERFLSNDKGMVDVKGQNYELIPFGTGRRICPGASFALEVLHLVLTRLILEFEMKAPEGKIDMRARPGFFHNKVVPLDVQLTPRTLD

SEQ ID NO: 3 - DNA, 2313 bp, Papaver somniferum
aaacacttgagtcatgccttgatatgctcatattttagtttgtcatattcactataactataaatttcaatacaatttctaaaactcatcatcattcaagagagatacaaataccttgatatccttttatcatcaatggagttattcataaagttaccatttatccaaccaattcctttcagtattattcttgttactacagtttcgattgttctattatacagtgtcttcttctgggttactgataagaaaaagaagaggaagaaagcaccaaatgctgcaggggcatggccgttaataggtcatctccgtctattgatgaacgacaaggaaccgttgtatagagcactagggagcatggctgataagtacggacctgcattcaacatccgattaggtaaccaagaagttcttgttgtgagtaactgggagatggtaaaacagtgttttggtaatcaaaatgataagctattttcgaatcgtcaaactacattagctgcaaaatacatgcttaatcaaacaacttctagcggattcgcaccatatggaccatattggagagagctacgaaagataatggtgcagcaattactctctaaacaatctttagaatcgtggaaacatctgaaaatcaaagagatggatgcttcatttagtaaacttaacgagttatgcaacaacaacggtactggaacagctaccctaattaggatggacgaatggtttgctgagttgacgttcaacgtgatcgcaagaaatgtctttggctaccaaagtggcggaaggtcgacagcgcttacgaacggagatacggaatcaaagggcgagaggtacaagaaaacattggaagaagcacttcatcttatgtcaatttttgcagtttcagacatatttccaagtctagagtgggtagatcggttaagaggccttataaggaatatgaaacgctttggagatgagctaaattcaattgcagggtgtcttattgaagagcaccgccaaaagagattacaatccgtatctaaaagtgataaaggagttggtgatgaacaagacttcgttgatgttctcttatcggttgctgaaaaatcgcaacttcctggagatgaccctgatttggtcatcaagtctatgattctggaaatcgtatcaggtgggagtgagaccacatcgtcaaccttaacttgggccctctgtctgttactgaaccatccgcatgtgttaaagaaggcaaaagaggaattagatacgcacgtaggaaaagataggcatgtagaagagtcagatacccctaagctcgtgtacattaatgcaattatcaaagaatcaatgcgattgtatccaaacggggcaatgcttgatcggttggcgttagaagagtgcgaagttggtggatttcatgtaccggccgggggacgcttatttgtcaatgtttggaagattcagagagatccgagtgtttgggagaatcctctggagtttaaaccagagaggtggtttttgagtaatggtgaaaagatggatgtggattacaaaggtcacaatcatgaattcataccatttgggataggtcggaggatgtgcgctggtatgctttgggcatcggaggtgattcatttggtgctgccccgtcttattcatgggtttgatatgaaagcagcaagtgccaatgggaaagtagatatggcagaaatggcaggcatggtgatttgttttaagaagacacctcttgaagttatggtcaatcctcgagagtagatgttttttttccttttgcatagtttatatattgaaaatgtaggccaagctagcaacctgtcgtacatttgacacaagatttttaagttcgtcaccatgttaaaagtctgtttgtttggttttttctcatagaaattttaatttatgctcctctaatttgtttcttatcatgcgagtactttgagtaactcagttactttgatgctttttgctggtaacacatcagagtgacgaagttagatgctgatacagacggagccagggattatacacccccagattttttgattcttgttttggtggaggatgtaaggggaagggtccctagaaaaacgtttaaacttagtctatgagtcatggttgcaggttcttggatatgaagtggaatatctaggtattctaaacttgagtttagagagacagatattgttgtcagatacttgaagttcagagagacagatattgttgtcaaagatctatgcttgcatgattgcatcctaaacaattttgatgcgaataatgtatacaaacgcgaatttaactcgtgcatttacg

SEQ ID NO: 4 - protein, 540 aa, Papaver somniferum
MELFIKLPFIQPIPFSIILVTTVSIVLLYSVFFWVTDKKKKRKKAPNAAGAWPLIGHLRLLMNDKEPLYRALGSMADKYGPAFNIRLGNQEVLVVSNWEMVKQCFGNQNDKLFSNRQTTLAAKYMLNQTTSSGFAPYGPYWRELRKIMVQQLLSKQSLESWKHLKIKEMDASFSKLNELCNNNGTGTATLIRMDEWFAELTFNVIARNVFGYQSGGRSTALTNGDTESKGERYKKTLEEALHLMSIFAVSDIFPSLEWVDRLRGLIRNMKRFGDELNSIAGCLIEEHRQKRLQSVSKSDKGVGDEQDFVDVLLSVAEKSQLPGDDPDLVIKSMILEIVSGGSETTSSTLTWALCLLLNHPHVLKKAKEELDTHVGKDRHVEESDTPKLVYINAIIKESMRLYPNGAMLDRLALEECEVGGFHVPAGGRLFVNVWKIQRDPSVWENPLEFKPERWFLSNGEKMDVDYKGHNHEFIPFGIGRRMCAGMLWASEVIHLVLPRLIHGFDMKAASANGKVDMAEMAGMVICFKKTPLEVMVNPRE

SEQ ID NO: 5 - DNA, 1572 bp, Papaver somniferum
cgcatataatccaatttgcattgtttatcgaccttgaggaacaattaggggatatggcaacaatgtctagtgctgctgtagaagtgatctcgaaagaaacgattaaaccaagaaatccaacaccatatcaacttagaaactacaatatgtcacttctcgaccaatattcttctctagtttatgttccgatcattcttttctaccctgctgcctccgacgctaatagtaccggaagtaagcaccatgatgatcttcacttgcttaagaggtctctttctgaaacgctagttcacttttatccaatggctggtaggatgaaagacaacatgactgttgactgtaacgacgaaggtattgactttttcgaagtaagaatcaaaggtagaatgtgtgacttcatgatgaaatcagatgcacacttaagtctgcttcttccgtctgaagtcgcttccacgaacttcgtgaaggaagcacaggtgattgttcaagtgaacatgtttgattgcggtggaactgccatttgtttctgtatatcaaacaagattgcagatgcatgcaccatgattaccttcattcgtagtttggcaggcaccaccaacatagctcgtcgtgggagctctattgctgcaccaaccacaaatcagaatttggttccttctttcgattcgacatcactctttccacctagtgaacaattggcatctcaagtttcctatcctacacaggatagtaccagcgtagataaacttgtcagcaaaagatttgtgtttgatgcggcaaagattacatctgcacgtgaaaaattgcaatccttgatgcatgataaatacaaatgccataggccgacaagggttgaggtagtttccgctttgatatggaagtcagcagtgaaatctgctccgcccggttctatatccactgtaacccatgccatgaactttagaaagaaaatggatccaccattacaagatgcgtcattcgggaatctttgtgtggttgttacagcagtattaccagcaacaacggcgacaacaacaaatccagcaaccaaaaaagttagtagtacgagtaatgaagagcaagtggcacttgatgagttaagtgattttgtagccctattgaggcgcgaaatagataaggtaaagggtgataaaggttgcatggagaaaatcattcaaaagttcatctatggtcatgatgcttccgtagcgaaagacagtgatgttgaagataaggtgacagctttgtttatgactagctggtgcaagtttggattctacgaagctgattttggttggggaacgccagtttgggtaactactgttccattaattgagccaaagtacaagaacatggttttcatgaacgatatgaaatgtggtgaaggaattgaagtgtgggtgaattttctggaggatgatatgaccaagttcgaacaccacctaagagagatcctccaactgttttgattttcaaccgtttccctaatagaggtcaattgtcgtgtttgtccatcttaactaccatctttattctcttgttttcatacttgtatttgtcttactccggtaa

SEQ ID NO: 6 - protein, 471 aa, Papaver somniferum
MATMSSAAVEVISKETIKPRNPTPYQLRNYNMSLLDQYSSLVYVPIILFYPAASDANSTGSKHHDDLHLLKRSLSETLVHFYPMAGRMKDNMTVDCNDEGIDFFEVRIKGRMCDFMMKSDAHLSLLLPSEVASTNFVKEAQVIVQVNMFDCGGTAICFCISNKIADACTMITFIRSLAGTTNIARRGSSIAAPTTNQNLVPSFDSTSLFPPSEQLASQVSYPTQDSTSVDKLVSKRFVFDAAKITSAREKLQSLMHDKYKCHRPTRVEVVSALIWKSAVKSAPPGSISTVTHAMNFRKKMDPPLQDASFGNLCVVVTAVLPATTATTTNPATKKVSSTSNEEQVALDELSDFVALLRREIDKVKGDKGCMEKIIQKFIYGHDASVAKDSDVEDKVTALFMTSWCKFGFYEADFGWGTPVWVTTVPLIEPKYKNMVFMNDMKCGEGIEVWVNFLEDDMTKFEHHLREILQLF

SEQ ID NO: 7 - DNA, 2156 bp, Papaver somniferum
aaaaaacaaaacaacctcaatctagctagagtcgtgaaaaagttttgtgcgactgttatttagttaattataaaatttcaatgaagtcgttaatgatgaacaagttattatttctccaacggattactgattctccttcgaccaccattatcagtacttttattgttacaataatatccattgtttttctctacactgtcttgttgataaggacgactaagaataagcagaagatagcagcaccaaaagcatcgggggcgtggccgttcataggtcatctcaaactattcatgaaacaagatactcagttttacagaactctaggaaccatgtctgataaatacgggtcggtgttcacacttcgattaggaaaccaagcaatcctagttgtgagcaactgggagatggtaaaagaatgtttcacaacaaacgacaagtcattctcgaatcgtccaagtacgttaagcactaaatacatgctgaatgacactaattctgtcgtgttttcaccttacggaacgtattggagagaaatgcggaagatattggtgcaaaaactactgatctctaaccaaagatcagaggcattgaaaaatctgaaaacgaaagaaatcgacaactcgtttgtaaagcttaatgatttatgcaacaacgatgtcagtggaggaggcacaaaagttaggatggacgaatggttggctgacatgatgttcaacattattgctaggattacatttggttaccaaagcggaggaggcgatgcacctggcgcttctacaacatccaagaatgtcgagagatacaagaaaacgttggacgagatgtttgttgttttagcgacgaggtttgcagtttcagatatatttccatctctggagtttatagaccgattgagaggtcttgtaaaggatatgaaaatcttgggagacgaattaaactccattgctggatgttttattgaagaacatcgtcaaaagagacgagaatcattatcctcattgttatctttgtcaaatgaatccgttggtgatgaacaagatttcattgatgttctcttgtcaataatggatcagtcacggcttcccggagatgacccagattttattatcaaaattatgatcctggaagcttttgcaggtgggacggacagtttaagtgcaaccttaacttgggtcctctctctactgctgaaccacccaaacgtgttaaagagggcaagggaggaaatagataggcatgtggaaaacggtaagcaagtggaagtgtctgatattccgaagctcggatacattgatgcaataatcaaagagacgatgagattgtatccagtcggagcattaagcgaacgatacacgactgaagaatgcgaggttggtcggtttaacgtacccgctggcacacgcttactggtgaatatatggaagatccacagagacccaagtgtgtgggagaatccatcagattttcaaccagagaggtttttgtgcagcgataaggtgggtgtggatttatatggccagaattatgagctgataccatttggggccggtaggagggtatgtccggctatagtttcatcactgcagacgatgcattatgcgttggcgcgtcttattcaaggatatgaaatgaaatcagccagcctcgatgggaaggtgaatatggaagaaatgatagccatgtcgtgccacaagatgagccctcttgaagttattatcagtcctcgggagccgaggcggagttaaatcttatgttccaattttacattagcatctttgattatgaaatgtattgctcttaagtttctttttgttttttatatttttaagcttgtatgtgatcatcagcgaaaatgatgatgacagaatcgtcaaaagaatcaatcgaacaagctatgttgtattaggcgcgccgaggaaaaattagaaaactgcacgaacaggtatgatttggcgcgttttattataggcgctccctgagcgcctggcacgcctaaaacacttaggtgagcactcagggcacctttttttctagccgtttcctgagcgtctcgcgcgcctagaacacttaggcgagcacccaggacgccttttacaacgtagagaacaagccttaataaacgaaatggattctttgaattcaaatttaagtggcac

SEQ ID NO: 8 - protein, 554 aa, Papaver somniferum
MKSLMMNKLLFLQRITDSPSTTIISTFIVTIISIVFLYTVLLIRTTKNKQKIAAPKASGAWPFIGHLKLFMKQDTQFYRTLGTMSDKYGSVFTLRLGNQAILVVSNWEMVKECFTTNDKSFSNRPSTLSTKYMLNDTNSVVFSPYGTYWREMRKILVQKLLISNQRSEALKNLKTKEIDNSFVKLNDLCNNDVSGGGTKVRMDEWLADMMFNIIARITFGYQSGGGDAPGASTTSKNVERYKKTLDEMFVVLATRFAVSDIFPSLEFIDRLRGLVKDMKILGDELNSIAGCFIEEHRQKRRESLSSLLSLSNESVGDEQDFIDVLLSIMDQSRLPGDDPDFIIKIMILEAFAGGTDSLSATLTWVLSLLLNHPNVLKRAREEIDRHVENGKQVEVSDIPKLGYIDAIIKETMRLYPVGALSERYTTEECEVGRFNVPAGTRLLVNIWKIHRDPSVWENPSDFQPERFLCSDKVGVDLYGQNYELIPFGAGRRVCPAIVSSLQTMHYALARLIQGYEMKSASLDGKVNMEEMIAMSCHKMSPLEVIISPREPRRS

SEQ ID NO: 9 - DNA, 1520 bp, Papaver somniferum
cttcgagaaaaattagaataaaaatcatactgcctttatttttagaaaagagataccgttaccttttaattttggtcgtggagttgaggcttgcctcttggtctagaaaaaaaaatctctataaatagcattaattctaccatttttataagtctcattgttgatattgaatcagaaactttcttctaaaatctttcaataccagtactgttagtttccgataagagccacactaatccattatggaaattcatttagaaagccaagaacaagaaatgaaatatcaatctcaaatctggaaccaaatatgtggcactgttgatacctctgttctgagatgtgcaattcaattaggtatatttgatgccattcataactctggcaaaccaatgattaccttaaccgaattatcaagcattgtttcatcaccctcttcatcttcaatcgaaccctgcaacttgtatagattagtgagatacttatcccaaatggatctcattagtatcggagaatgtttgaatgaagcaactgtttcattaacaggcacatccaagttactacttagaaaccaagaaaagagtttaattgattgggtattggcaatttmttgcgaaatgatggttgttgtttggcacgaactaagtagctctgtttcaactcctgcggatgagcctccaatcttccagaaggttcatggtaaaaatgctttagaattagcaggggaatttccagaatggaatgatctgatcaacaatgctatgactagtgatactagtgtaactaagccagcgctaatacaaggatgtggcaaaatcctgaacggagttacatcgttaattgatgtcggtggtggtcacggtgccactatggcctacatagttgaagcttttcctcacataaaaggtgcggtaatcgatttaccacatgttgttgaagccgctccggagcgtccaggtgttgagttcatcagcggtgatatattcaagtccatttctaacgctgatgctgtgttgttgaagtatgtcctgcacaattgggaagatacggaatgtgtgaatttactgaagagatgtaaggaagcagttccggcagacaaaggaaaagtgatcataatggatttagtaatagacgacgatgataacagtattttaacgcaggcaaagttgagccttgatctcactgtgatgaaccatggaggaggtagagaaaggactaaagaagattggagaaatctaattgagatgtctggatttagtaggcatgaaataattccaatatctgccatgccatcaattattgttgcttatccttagttaagtcacccgcatgtttacttgaacgggaataagttgggggcgtgttgaatctgttaacatcgcaattgtgcctttactttatgcattctcattccggtagaaactgtttgggggcattcggattctgctgagcccttttatgtatgtttgtttgttggttggttggttttcaagtaactgaagtttcttctctgttttcaaggc

SEQ ID NO: 10 - protein, 356 aa, Papaver somniferum
  misc_feature (122)..(122): Xaa can be any naturally occurring amino acid
MEIHLESQEQEMKYQSQIWNQICGTVDTSVLRCAIQLGIFDAIHNSGKPMITLTELSSIVSSPSSSSIEPCNLYRLVRYLSQMDLISIGECLNEATVSLTGTSKLLLRNQEKSLIDWVLAIXCEMMVVVWHELSSSVSTPADEPPIFQKVHGKNALELAGEFPEWNDLINNAMTSDTSVTKPALIQGCGKILNGVTSLIDVGGGHGATMAYIVEAFPHIKGAVIDLPHVVEAAPERPGVEFISGDIFKSISNADAVLLKYVLHNWEDTECVNLLKRCKEAVPADKGKVIIMDLVIDDDDNSILTQAKLSLDLTVMNHGGGRERTKEDWRNLIEMSGFSRHEIIPISAMPSIIVAYP

SEQ ID NO: 11 - DNA, 1492 bp, Papaver somniferum
aaatcttgtaattaaaaaagatataaatgttagatatcaattacatgatcattatccaataatatacaaaaatactaacttgattggtggtaggttatttaaccatgtatgtgattcattgtagcaattaaatcgaaaaaaagtttaaaactgtctataacttttttgaatgatacgtacgtactttataactgtcgaaacaaagtttcaccttgtcatccatctgttagccgaccatatagaagaaaggttaaataaaatgggctctgtaatgaatcttcttaatagtaagagagggaccctaaattctcttatactataaatatcgactccatttatccaaagttcaaacatcatccaataaaaatccaacaatggcagatccttatgaattcctaatgtgcattcacaatcctgaagaagataccctaacaagaaattttccgattcctgctactcccttagatcaaaacaccaaagacatttctttaaatcctgataggaaaacctcacttcgaatctttcggccaccaaccaaagaacctcctgtaacaaagaataagctgcttcctatcataatttatttccatggtggaggtttcattcttttcaatgcagattcaactatgaaccatgacttttgtcaatcgattgctacacatatacccgcgctggtcgtttctgtagactaccgtcttgctcctgaaaaccgacttcccgctgcctatgatgatgctgttgatgctttaaactgggtcaaagaccaaggtttaggcaaactaaataatagtgaagtatggttaaaagagtatggtgacttctcaaagtgtttcattatggggtgcagctcaggtgctaatgttgcatatcatgccagtttaagagcaatagaaatggatcttgaaccagctaagattaatggattaatattacactgccctttttttggtagtcttgagagaactgaatcagattcaaaagtgatcaacaatcaggacttgccgcttgccgtaagggatgtcatgtgggaactggcgttgccgcttgggtctactcgtgatcacgtttattgtaatccgaatattgatcatgatggatcatcatctggaaatatggtggggttaatcgagagatgttttgtggtaggattttatggggatccacttattgatcgacaaattcagctggtgaagatgctggaggaaaaaggtgtgaaggttgaaacttggattgaacaaggagggtatcatggggtgctatgctttgaccctatgatacgtgaaacctttttggaaaaactaaaacattttattttaaacgacgaatttatatactaaaatatattattagtattaaacaatgaaattcttattttttctaaaatgagcttttggacgaaacattgtgtacgaactagctgatgtaatttttcgttttaccggatttttcattttttttgctttctttctgctctcttttataagtcgttctt

SEQ ID NO: 12 - protein, 320 aa, Papaver somniferum
MADPYEFLMCIHNPEEDTLTRNFPIPATPLDQNTKDISLNPDRKTSLRIFRPPTKEPPVTKNKLLPIIIYFHGGGFILFNADSTMNHDFCQSIATHIPALVVSVDYRLAPENRLPAAYDDAVDALNWVKDQGLGKLNNSEVWLKEYGDFSKCFIMGCSSGANVAYHASLRAIEMDLEPAKINGLILHCPFFGSLERTESDSKVINNQDLPLAVRDVMWELALPLGSTRDHVYCNPNIDHDGSSSGNMVGLIERCFVVGFYGDPLIDRQIQLVKMLEEKGVKVETWIEQGGYHGVLCFDPMIRETFLEKLKHFILNDEFIY

SEQ ID NO: 13 - DNA, 1464 bp, Papaver somniferum
taactaacaggcaaacaataacaggttgcacctacaacattcaatttttattttggtaaatgaagttcagttggagagtaaccacatctttgttgtcggcattgcccccacaatactgagtgttttggctgagtgtagtctgactgtaggtaagctacaactgcatgttgcagataataatcactaactgattattcatgcatacctaacagtcatattgttatagttcccaaaaaaaattctcgaactataaaggcatgcatggacagaaaaatatatcagagagatatcagaaattcaaagagatggaaggaacagggaagatagtatgtgtaacaggtggagctggatacttggcatcttggctgatcatgagattgcttgaacgtggttactctgttcggaccaccgttcggtctgacccaaaatttagggaagatgtgagccaccttaaagctcttcctgaagctacagagaagcttcaaatttttgaagcagatcttgaaaacccagaaagtttcgacgatgcgatcaacggttgtgtcggtgtctttctcgttgctcaaggaatgaattttgccgaagaatatactcttgaaaaaataatcaaaacatgcgtggaaggaactcttagaattctacagtcatgcttgaaatctaaaacagtgaaaaaggttgtgtacacatcttctgctgatgcagcaatgatgataagtaatctcaaagctgttaaagaaattgacgagacaatatggtcagaagttgacaatttcattagcaaaccggaacaagttattcctggattgccctcatatgtggtttcaaaggtactgacagaaagagcttgcctaaagttttctgaagaacatggtttggatgttgttactatacttcctccgttggttgttggaccttttatcactccccatcctcctcccagtgtatctatagctctttcgataatttcaggtgatgtgtcgatgatgcttggtgttagacttgaaaatgcggtacatatagatgatgttgctttagcacacatattcgtttttgaatgtgaaaaagcaaaaggaagacatatttgttcttcagttgattttccaatgcatgatctgcctaaatttatatctgagaattatccggaattcaacgtaccgactgatttactaaaggatattgaggaacaagaaccagttcatctttcctcagataagctgttgagtatgggatttcagttcaaatatgattttgcagagattttcggtgatgcaatacgatgtgccaaagagaagggtttcctttagagaccaactatagtttggttcggaggagatgtgggagtagctagcccaaaatgccctgctcgcactagcttatattattgttattgtttttcaaatgaataaacgggcagtttttttttttatgaacttgattttacaacgaagagcctttggctatatg

SEQ ID NO: 14 - protein, 348 aa, Papaver somniferum
MHGQKNISERYQKFKEMEGTGKIVCVTGGAGYLASWLIMRLLERGYSVRTTVRSDPKFREDVSHLKALPEATEKLQIFEADLENPESFDDAINGCVGVFLVAQGMNFAEEYTLEKIIKTCVEGTLRILQSCLKSKTVKKVVYTSSADAAMMISNLKAVKEIDETIWSEVDNFISKPEQVIPGLPSYVVSKVLTERACLKFSEEHGLDVVTILPPLVVGPFITPHPPPSVSIALSIISGDVSMMLGVRLENAVHIDDVALAHIFVFECEKAKGRHICSSVDFPMHDLPKFISENYPEFNVPTDLLKDIEEQEPVHLSSDKLLSMGFQFKYDFAEIFGDAIRCAKEKGFL

SEQ ID NO: 15 - DNA, 1388 bp, Papaver somniferum
attatccaaacaaagtttcacattgtcatccatctgttagccgataatatacaagtatacaagaaaagcaaaataaaatgagctcccgaataaatcttcttaatagtgagagtgggacgctaaatttccttaatactataaatatccactccatttatccaaagttcaaacctcacccaataaatatccaacaatggcagatccttatgaattcctaatgtgcattcacgatcctgaagaagataccctaacaagaaattttccaattcctgctactcccttagatcaaaacaccaaagacatttctttaaatcttgataggaaaacctcacttcgaatctttcgacccccaaccgaagaattttgtgtaacaacaaataagttgcttcctatcataatttacttccatggtggaggtttcgttcttttcaatgcagattcaactataaaccacgatttttgtcaatcgattgctacacatttacccgcgctggtcgtttctgtagactaccgtcttgctcctgaaaaccgacttcccgctgcctatgatgatgctgttgatgctttaaactgggtcaaagaccaaggtttaggcaaactaaataatagtgaagtatggttaaaagagtatggtgacttctcaaaatgtttcattatggggtgcagctcgggtggtaatattgcatatcatgccagtttgagagcaatagaaatggatcttgaaccagttataattaatggattaatattacacagccctttttttggtagtcttcagagaactgaatcagatttaaaagtgatcaacgatcaagacttgccgcttgcggtaagggatgtcatgtgggaactggctttgccgcttgggtctagtcgtgaccacgtttattgtaatccaaatattgccaacgatggatcatcatccggaaatatggctgggttaatcaaaagatgtttggtgataggattttatggggatccacttattgatcgacaaattcagctcgtgaagatgttggaggaaaagggtgtgaaggttgaaacttggattgaacaagaaggctatcatggagtaccatgctttgaccctaagatacgtgaaacgttgttgggaaaaataaaatattttatttgattcagtttatcttatattattactaataaacaacgaattatacgaaagctttcggaaaacgttttcagatgtggctaataaacaacgttgtacgtgaaaatgtggctaataaacaacgaattactaataaacaacgttgcacgtgagcttgttgatgtaatttctcgcttcacctttcttttttccaattttttttcgcgtttatttctttttaaaactgttgttgctttgtgtcttatttcctgtttttgat

SEQ ID NO: 16 - protein, 313 aa, Papaver somniferum
MADPYEFLMCIHDPEEDTLTRNFPIPATPLDQNTKDISLNLDRKTSLRIFRPPTEEFCVTTNKLLPIIIYFHGGGFVLFNADSTINHDFCQSIATHLPALVVSVDYRLAPENRLPAAYDDAVDALNWVKDQGLGKLNNSEVWLKEYGDFSKCFIMGCSSGGNIAYHASLRAIEMDLEPVIINGLILHSPFFGSLQRTESDLKVINDQDLPLAVRDVMWELALPLGSSRDHVYCNPNIANDGSSSGNMAGLIKRCLVIGFYGDPLIDRQIQLVKMLEEKGVKVETWIEQEGYHGVPCFDPKIRETLLGKIKYFI

SEQ ID NO: 17 - DNA, 680 bp, Papaver somniferum
aaagtaattttaagtgtttttagttttgttacaagtttggtgaatgatctttgatatattttttttttgaagtagtgaatgaagtaatgttctacttcccataggatttgctctaacgattaactatgtttgtcccaaagggttgtatgacttacatacacaatattaaaagattcgaggataaggatatgtttattaaccaactcctcaaaacatttagacctggatcaatcatttcgattcttctcagacaattacgacatgtatgaatcgatggatacatttgaaacacatatccttacccgtgcagttacgacatgggttgagacctagtgattacatataaaacaactaattataccaatgacttgagttggaaactagtcccatgatcaattttttatcaatcaaaagaaatttatacgaaaggaaactatatgattgccatgactcgtaaatatacacaagcaagatggaggtcctattaactccaatcaaaccacaatagataaatatatcgtgaatcatgtgtggccaatatatacccacacttctatatataagtgcatccacctctctttgttttccaaaacaaaacataaacacaatttattcagagatatctggatggatactgcagaagaaaggttgaaagggcaagctgaaatatgggagcatat

SEQ ID NO: 18 - protein, 355 aa, Papaver somniferum
MDTAEERLKGQAEIWEHMFAFVDSMALKCAVELGIPDIINSHGRPVTISEIVDSLKTNTPSSSPNIDYLTRIMRLLVHKRLFTSELHQESNQLLYNLTRSSKWLLKDSKFNLSPLVLWETNPILLKPWQYLGKCAQEKSSPFERAHGCEIWDLALADPKFNNFLNGAMQCSTTTIINEMLLEYKDGFSGIAGSLVDVGGGTGSIIAEIVKAHPHIQGINFDLPHVVATAAEFPGVKHVGGDMFVDIPEADAVIMKWILHDWSDEDCTIILKNCYRAIRKKKNGKVIIVDCVLRPDGNDLFDKMGLIFDVLMMAHTTAGKERTEAEWKILLNNAGFPRYNVIRTPAFPCIIEAFPE

SEQ ID NO: 19 - DNA, 1371 bp, Papaver somniferum
atggcaacaatgtctagtgctgctgttgagatgatctccaaggaaatcattaagcccacaactccaaccccatatcaacttagaaacttcaacatctcacttttcgatcaatatatgcctccgaattatactacggtcattctattttaccctgcttccatcgctgcagatagtaccggtagtgagctccatgatgatcttggcttgctcaagaggtctctttctgagacactagttcacttttacccaatggccggtaggttgaaagataacatggttgtcgagtgcaacgaccaaggggttgacttttacgaagtgaaaatcaaagctaaaatgtgccacttcatggtgaaaccagatgaatttcccttaaatctgcttcttccatacgaagtcgtttccaagaattttgtcaaggaagcacaggtgattgttcaggtgaatatgttcgattgtggtggaactgccatttctttgtgtgtatcgcacaagattgcagatgcatgcaccatgagtacattcattcgtaattgggcaggaaacacctactcagctcgttgcggtggtgcaccaacaacaaatcagaattcttttccttccttcgattcggcatctctcttcccacctagcgaacaacttgtatttccatcagaagtgccacccaccctcgtttcccatcctaccgacgatagcagaagagaaaaaagtgtcagcaaaagatttgtgttcgacgcggtaaagataaactctgtgcgcgaaaagttaccagtactgatgcatgataactacaaaagcagcagtaggccaacaagggttgatgtagttaccgctttggtgtggaaggcggccatgaaatccgctcctagcgatgatgttttaccaacggtaaatcatgtggtgagctttagaaagaaaatcgacccgccattacccgatgtgtcatttgggaatctctgcgcggtagttgcgacggcggtatctccaggagcaactgtgacaagtaggaatgatggggttgaggtgcaagaggtactcgaggatcagttagccgaattagtagctcagctgaggggagaaaaatacaaggttaagggtgataaaggttgcattgagaaaatctttctaagttttgttggtggtgacaacgctttgtggatggctagctggtccaagtttggattttatgatgctgattttggctggggaaggccagtttgggtaactactgatctatcaattgttgagccgaaccagaacctaatttgcatgatggatacaaagtgtggtgaagggatagaagtgtcggcaaaatttcttgagaatgacatggccaagttcgaacttcacctaagcaagatcctggaattgttt

SEQ ID NO: 20 - protein, 457 aa, Papaver somniferum
MATMSSAAVEMISKEIIKPTTPTPYQLRNFNISLFDQYMPPNYTTVILFYPASIAADSTGSELHDDLGLLKRSLSETLVHFYPMAGRLKDNMVVECNDQGVDFYEVKIKAKMCHFMVKPDEFPLNLLLPYEVVSKNFVKEAQVIVQVNMFDCGGTAISLCVSHKIADACTMSTFIRNWAGNTYSARCGGAPTTNQNSFPSFDSASLFPPSEQLVFPSEVPPTLVSHPTDDSRREKSVSKRFVFDAVKINSVREKLPVLMHDNYKSSSRPTRVDVVTALVWKAAMKSAPSDDVLPTVNHVVSFRKKIDPPLPDVSFGNLCAVVATAVSPGATVTSRNDGVEVQEVLEDQLAELVAQLRGEKYKVKGDKGCIEKIFLSFVGGDNALWMASWSKFGFYDADFGWGRPVWVTTDLSIVEPNQNLICMMDTKCGEGIEVSAKFLENDMAKFELHLSKILELF

SEQ ID NO: 21 - DNA, 1599 bp, Argemone mexicana
atggataattttcttctccagttccaaccaatttcaattgcagctttttttgttgccctagtttttctgtattggagttatggaagaaaaagcaacaaaaccctaaaaccaagagcaccagaagcagcaggaggaagaccaataacaggtcatcttcatcttttttatggagaagaattaactcatcgaaaactaggttccatggctgataaatatggaccagttttcaatattagatttggttcacataaaaccctagttgtaagtaattgggaaatcgttaaagaatgtttcactacaaatgatcgattattctcaaatcgaccaggtactttagctattaaactaatgttttatgatactgattcagtaggttatgcaccttatggaaattactggagagaattaagaaaaatttcaactttaaaacttctctctaatcatagaatagaaaccctaaaacatttaagaacttctgaagttgaatcctgttttaaacagctttataatcaatgggaaatgaaaaatgaaaacagggtagaagttgataaattagggtttgcttcagtaaggatggataattggtttggggatttaactttcaatgttgtagcaagaattgttgctggaaaaaagaattttgcaggaggtgcagtaaatggtgatattggagctcagagatataaagtagccatggatgaatcttttagattaatgctaacatttgcatattcagatgtgattccatcactgaaatggttagacaaattaagaggtttaattagagatatgaagcgttgtggatctgaaattgattcaattgttgctagttgggtagaagaacatcgtttaaagagaaattcttctgaaaataataatttagatcttgaagaagattttattgatgtttgtttggatattatagagagttcttcattacctggtgatgatccggatactgtcatcaaatctacttgtctggatatgatattgggtgggagtgataccacgacagtaaccctaacatgggccatctccttaatattgaacaatcctcacgtgttgaaaagggcaaaagaggaattaaattccgtagttggaaaagatcgacgtgtagaagattcagacatccctcatcttacatacatccatgcaatcatcaaagaaaccatgagactctaccctgctggaccactgatcgaaaggaggacaatggaagattgtgaagtaggtgggtaccacgttccagctggcacacgtttattggttaatgtatggaagatgcaaagagacggggatgtgtataaagacgatccattggtgtttagacccgagagattcatgactagtaatgctgatgtggatctaaagggtcagcattttgaactgataccattcggtgcgggtcgcaggatatgcccgggtgtgtcatttgcggttcagttgatgcatttggtattggctcgtcttctacatgagtttgaaattactacaataccttctgaaccaaaggtagatatgtctgaaagtggaggattaatctgtcataagataaagccactagaagtgctaatcaaaccccgactcgagctgaactaa

SEQ ID NO: 22 - DNA, 1614 bp, Argemone mexicana
atggatttctcatcaatactactacttctcaatattaattgcttcacaacttccttggtcacccttcttgttcttgtcatggtttttctctacaataatacaagatttactaaacccaaaggtaataaaaagatgattaaaccacccagactacccggtgcacgccctcttttaggtcacctccatctgtttggaccaggtgagcttcctcacaaggttctctcaaccatggcagataaatacggtcctgcctttacaattaagttcggtaaacacacaacattagttgtgagcgatatccataccataaaagaatgtttaactactaatgacatcctcttttctaaccgtccttcttctatagcctttgatctcatgacttacgctgatgactccgtagctttcgcacattatagtccttattggcgtgagcttagaaagatatctactctcaaacttctatctaataaccgtcttcaatctatcaaacaacttcgactctctgaggtgaacgtatgttttaaagaactatatagtttatgcaacaataataataaaagtggagctccggttttgattgatatgaagaaatggttcaaagaggtcacgactaatatagtcattagagttattgttggtaaacaaaattttgggtctaagattgtgcgaggcgaagatcaagaagctgccaattacaagaaaatcatggatgaactttcacgccttgctaaattgtctatgttctctgattatgctcctttacttagtttgtttgattacttccgaggaaacgtgagtgctatgaaaagaaatggtaaagaattaaacgcgatgcttcagaattggttggaagagcataagaggaagaagaactcatcaatatcgaacgatgatgaacaagatttcatggatcttatgttgtcaattattgacgaaactaagctatacggacgtgacgctgatactttcattaaagctatttccctttctatgatcgtgggtggaatagacaccgttgtcgtgactctaacatggattctcgccttaattatgaagaatccttttgctttgaaaaaggctcaagaagagttagactttttcgtcggaaaggaaagacaagtagaagattcagatctcaagaacttggtatacatgaatgccatcgttaaagaaacgctgcgattatacccattaagttgtattcttgaacgtgatacgaaggaagactgtgaagttggtggctactacgtcgaaggtggcacacgtttactaataaacgcatggaagttacaacgggacccgaatgtatggacagacccttcggaatttaagccggagagatttctaaatgagaatgcagacatagatgttggtggccaacattacgaattaataccatttggagctggtagaagagtgtgtcctggtgtatcttttgcactccagtttatggatttggttctggctcgtctcatccatgggtatgaattgggaactctaaatggtgaagatgttgacctaactgaaaaaactgaaggacaaattaatttcaaagcaacccctctggatctcatcgttactcctcgtctccaccccaatctttatgattattag

SEQ ID NO: 23 - DNA, 1569 bp, Berberis thunbergii
atggaatcaattgagtttctagtaactctgctactcagcctgcttgccctattttgtgcttatgcatggaagaggaaaaaccatacaaaggatagcaaaatcaaagagccaccccaaccagccggagcatggccgataatcggccaccttcatctaatatcccgcggcggccttcctcatataaacatgggggccatggcggacaagtacggtccagttttcatgatccggctaggagtaaatcgagctgtgattgtgagtaacacggagatcgtcaaagagtgcttcacaaccaacgataaattcctactaaaccgtccagttgggttagccttaaacctcatgtgctacaacaacgccatgttcgggttctgtcggtacggtccatattggcgagagatacacaaaatagtcatgcttgagctcctctcgaacagccggctcgagtccctgaagcacgtatgggactcggaaatatcgacatccatcgaagagttgtaccaattatgtcaaacacaaaacaagacccatgaaggcccagttttggttgaaatgaaggattggtttgcagatatggcactcaatgtgtcccttagaatgattgctgggaaaagatactttggtgcaagtgccggtggtaataaagatgaggcaagaaagtgtcaaaagaccataagagatttctttagacttgttggcttgtttatagtgtctgatgcacttccatttcttaggtggctagacttgggagggcatcagaaggagatgaagagaacatttgaagatcttgactatatgcttcaaggatggttggatgagcataaattgaatagaaaatctggtgtgaatggtgatcaagatttcatggatgtgatgttatctattcttgatgattcaaaatttccggattacgacgttgacaccgtcaacaaggctacgtgcttccaattgatcataggaggaactgatactacaacggtcactctaacatgggccctttccttgatgttaaaccacccacatgtattgaaaaaggcccaagatgagttggacatccaagtaggcaaacacagacaagtggaggaatcagacatcaagaacctaaaataccttgaagctgtgatcaaagaaaccttacggatgcgcccagtaggcccactgttaggcccacgagagacgatcgaggactgcaccattggtggatatcgagttcgagcaggcacacgtgtaatggtcaatgcttggaaggtgcatcgtgacccatcggtttggtcaaaccctgatgacttcaaaccggagaggtttctcaagaaggatattgacttcagggaccaaaactttgaattcatccctttcgggtccggtagaagggcctgccctggaatatcatttgccgtggaagtactgcccatggctttggcccgtttactacatgggtttgagcttaagactcaattgggttgcaaggtggatatgacagagcatgccggtttagttcatgctaaagctacccctttggaagttcttgtcagcccacgcctgtctcgagagttgtatgtatcgtcttag

SEQ ID NO: 24 - DNA, 1543 bp, Berberis thunbergii
gggatcacttgctctcattgccattattattctttccaacattgtcaaaaaatcttcgaaatctctttccagtaaaggtggcaagagtgcacccgtggttcatggtgcgtggccagtcatcggtcacctgcacctactgatgggtaaggagttgcctcatcatgcattagccaaactggctgataagtacgggccagccttcacactcaacattggcgcgtatcaagaactagtgatcagtactcgggatcttgcaaaagaatgtttcaccaccaaagacaagttcttcctaaatcgtccaagcaataaggccatgaagatcctgacatatggtgaagcatcagttgggttcgcaccatatagcccactttgggtcgaaatgcgcaaggttacgaaatctaatctcttatctcaccaaagggtcttgatgcaaaatcgttcacgagcatcagaaattgatgcaagttttaaacaactatatgaacaatgcaatgggaagagtggagcttcggtggaaatgaaaaactggtttgaagaagtgatgttgaatgtggttactaggaatgtttctgggaaaagaagttttggtaccaaggcaagacttggtgatgcagaggccgtgaagtataaaagggttattgatgagaccgcacggtttatggggaaccttgtgatctcagatatggttccaagtctttggtggttggataacatgttgggtgctgagagtgctatgaagaaacttgccatagaattggattctctacttggtggttgggtggaggaacatagagggaagaagttgagtgacgacgaggagggggactttatcagtcttacatgggagatgatcgatcagattcagcttcatggtcttgcccctgagacgttcatcaagtctatgtgtgtcggcgtgctgttgggtgggagtgataccacatcagtagccctaacatgggcactctcgctaatgttgaacaatcgcgaggtgttgaagaaggcccaagaagaattggacttccacgtaggaaaggaccgcaaagtggacgactcggacctcaagaatcttgtttacttacaagccattatgaaggaaacaatgaggatataccaagtaggtcctctaattgaacgagaggccgttgaggactgtgaagtgggtggattccaaatcaagaaggggaaccgtatactagtgaacctgtggaagttgcaacgtgaccctgaagtgtggtcagatccgtccgaatttcgacctgaaagatttcttgaggataagtctaaggtggacttgaagggccaaaatgctgaactaatgccgtttggcagtggtcgacgtatgtgtccaggagtttggtttggggtgcactccacttctttggtacttgctcgtctcatccaagggtttgaaatagagacaccactggatgcaaaagttgacatgacggagacatcaagtgtgaccaattataagggaagtcctcttgaagttattgctcgactccccggctcgaacctaagctttatgatttgtagttatgta

SEQ ID NO: 25 - DNA, 1638 bp, Chordyalis celanthifolia
atgactccctcaatttcacaaccttttgagcttcttcttcttctgatgacaatggagtctcttcttctccaatggcaaccaacttccattgctgttcttcttctcgccatcacaattttcctctacaccttcacaaaatcaccccctaaaacccacaaaaaactagccccagacgcaacaggaggacggccattaatgggtcatcttcatctcttcaattcaaacgaattaacacatcgaactctaggatccatggctgataaatatggtccagctttcaacattcgattcggttcacacaaaaccctagttgtatctacttgggaaatcgtcaaagaatgtttcaccaccaacgatcgatcattctcaaatcgcccaggaactctatacatcaaactcatgttctataacgaagattcagtagggtatgcaccttatggagcttactggagagatcttcgtaagctatcaacactgaaactactctcaaaccatcgattggaatcattgaaacatttgagggtttctgaaatgaatgaatgtttcaaacagctttatgagatttgtaacaaaggaagtaaatctgttgctgttagaatggataattggtttggtgatttgacttttaatgttgttgcaaggattgttgcagggaaaaggaattttgcttcaattagtaatgatgttggagctatgagatataagaatgcaatggatgaagcttttagattgatgactgttttttcattttctgatgtgattccatcacttggttggttggataatttgagaggattagtgggtgatatgaaaaaagctgggaaagaaattgattcagtggtttcaggttggattgaagaacatcgtgagaagagaaagagaagatcatctggtggtaataacagagatggagaattagaagaggaggatttcattgatattactttgtctatcttggaaacttcaagtctccctggtgatgatcctgacatgactatcaaatctacttgcttggatatgatcttgggtggtagcgacactacaacggtgactatgacttgggctctctccttgctattaaacaatgctcacgctttgaaaagagcaagagaagaactggacttgcacgtcgggagagatagacaagtggaagattcagatatcaacaatttggtctacatccaagcaatcatcaaagaaacaatgagactatacccagctggacccctcattgaacggatgacaaaggaagattgtgaggtaggtggattccacatcccagccggaacacgtttgttagttaatctctggaagatgcaacgagacccaaatgtgtgggaggatcctttggaatttcgacctgaaagattccttaccaacaatgcagaaatagatctaaagggtcagcatttcgaactcatcccatttgggacgggtagaaggatatgcccaggtgtttcatttgccttacaattgatgcatttggctctcgctcgtttacttcacagttttgaagttgcatcccccatggatgccaagattgatatgactgaaaccgcaggccttataagccacaaggtaattccgctagaagtcctcatgactccacgccttgactctaagctttatgattattag

SEQ ID NO: 26 - DNA, 1572 bp, Chordyalis celanthifolia
acacacacaaccgaaaagaatttaccaccggaagtgcctggtgcattgcctgtcatcggtcacctccacaagttaggtggtcggaaaggtcttctaccatatcatgttcttggagccatggctgataagtacggacctgccttcacattccagtttggttctaaccgaacccttgtgattagtaattgggaaatggtaaaagaatgtttcacgtctaccaacgataagttattcgcttatcgtccaacagcattgttcaataaggaagtattctgtagtgaccattcttttggattcggaccttatggcccgttctggagggagatgcgtaaggtttgttcgcttcatcttctctccaattatcgcctcgagctcttaaaacactctcgaaaatccgagatggatgagtgtttcaaggagttgtaccaactatggagtgcttcaaatattagcaaagacaagcaacctgctgttttggtggtggaaatgaagaaatggttcgaagatgcgatgttcaatgttgcttcgagagttgtggtgggaaaaggaagtttgaaatctcatgagaaggctggagggagtgataatgaagtagcgaggaacaaatataagaaaggcatggatgaggctagacgacatatgggaacatttgttatatcggataggatcccgtttctttggtggattgattatttacggggtatccatagttctatgaagcgaacggcgaaagaccttcatgccattgtagagacgtggttagaggaacaccgtcttcattgtcacaaacggagagtattgcaactcgatgccaaccatgaggttgaagatatggcgaaagaggaagaaaaagattttatggatgttttattgacgatggcggacgagggagccatcaaaatctttgaccatgatcttgataccgttatcaaagctaattgtctggatatggttatcgctggaaccgatacaccaaccgtaatgcttacatggaccctttcactattactaaacaatccagatgttttgaaaagagttcgagatgaactggatttacatgttggaaaagaaagacaagtagaagaatctgatgtcaagaatttggtctatctccaagcagttttcaaagaaaccctgcgtttatacccagctgtacctctaaatgaacgtttgacaatggaggattgcaatgttgggggttacgatatcccagccggtacccgtctattaatcaacatttggaaggttcaaagagacccaaatgtgtggcaggatccctcagaattccgtcctgaaagattcttgagtaaggaaaaatccaccatagatgtgaggggtctagattttgaactcattccattcgggacaggtagacggatgtgcccagggatttcattttccctccagctcatgcatttgggactcgctcgcctcattcacggctttgaattagcaactccgatggatttggatgtcgacatgtctgcaaatcctggagctttcaactataaatcaaccgatcttcaagttcttgttagcccacggtttcattctaagttctacggttgttaa

SEQ ID NO: 27 - DNA, 1611 bp, Chordyalis celanthifolia
atggatttccttgctcttcaatggttcccagcttccttgactgcccttcttgccttggctgtcctttacaacttctggaccaagcaaaggacttacaagaatggaaagacgagtactaaacaggcacctgtagctgccggtgcatggccagttcttggtcaccttcacttgtttggtggaggtgaactgcctcacaagatgcttgctactatggctgataaatatggacctgccttcacaatgaagtttggtacacatcaaacactagtagtcagtaacaccaagattgtaaaagaatgtttcacaaccaatgatactttgtttgcaaaccgtccatccaccacagcctttcacctcatgacctacgataacgagtcggtagccttcacaccatatggtccattctggcgtgagctgagaaaaatctcaacactcaagcttctttctaaccaccgtctccaagcaattaaggatgtacgtgcctcggaagtgaatgtgtgcttcagggagttgtacagtcaatggaggataaataaaagcgagcctgaaaccagtgatcatcagggtccaattctggttgatatgaagaagtggttcgaagaagtctcagacaatgtggtgcttagagtgattgcagggaaacaaaactttggctctaagattgtgcatggagacaaagaggcccttcactacaagaaaatcatggacgagatactacgtcttgcggcagtttccatgctttcagatgtggctcctttgcttggttggttagatatgttccaagggcatttaagtgccatgaaacgaaatgcgaaagaggtagatactatgctatgtaactggttggaggagcatcgaacgaaaagactctccagcgatcatgacggtgtagagcaggatttcatagatgtcatgctgtcaatcgtggaggagaacaagttctctggccacgacaatgataccgtaatcaaagctactgtcttggccatgatcatgggtgggactgataccaccgctgtcagcttaacttggattgtgtccttgttgatgaacaaccgccacgttttgagaagggcacaagatgaacttgacttgcacgtggggaaggatagacaagttgatgattcagatctcaagaacttggtttatctcaatgctatagtcaaggaaaccatgcgtttgtacccattaggtgctcttcttgaacgtgaaaccaaggaggattgtgaggttggtggtttccatgtcaaaggtggaacacgcctattagtgaatgtatggaagctacaacgagacccaagcttttggaccgatccaacagaatttaaacctgaaagatttttagcagacaaggcgaacatagatgtcggtggtcagcattttgaactactgccatttggggctggtagaagagtgtgcccaggagtctcgttcgcactgcaattcatgcatttggtacttgctcgtctacttcacggatttgatttggctacccctatgaatgcagatgtcgatctaaccgagagtactgaaggacatgtcaaccagaaagcatcccctctcaatctacttgtcactccacgtctccattctaagctttatgaatactag

SEQ ID NO: 28 - DNA, 1632 bp, Chordyalis celanthifolia
atggagtacacattctcatcagcctcattgttctcctcctcctcccttcaacaatggctctcaacccttctacttctaatttcctccatcaccatttctctttaccttactcgtcgcggtaagtcatcaccgccaatggtccctggagcatggccactcattggtcacctacatttacttggtgggaacgatccacttcatatcgttcttggaaccatggctgataagtatggacatacctttgccatgttattcggtaaacatccatcacttgttgttagtagtagtgacattgtaaaggaatgtttcacttctacaaacgataaattgttttcgcatcgtcatgttcctaccggagttaaatacatgttctacaataatgactcgtttggttttgcaccttacgggccttattggcgtgaaatgcgtaaaatgaattcactttctcttttctcacaccatcgcgttgaaatgcttaaccgaattcgaacatctcaaattaacatttggtttaaaaacctatatgaaatgtgtaccaaggagaagagtactagtacaagtagtgatggagttgtggttgaaatgaagtcatggtttgatgaaatgtttttcaatgtacttgtgaatatgattgttaaacctattaatgatgatgaagagttggtgaagaaatacagagaagtggcgaccgaggcaggacgcctattgtcaagcatggctgtttcggatatggttccatctctaggatggttggatcatttgtttgggattgtgggtaaaatgaagaaaactgcaaaagatatggatgctatcctcactacttggttagaacagcataagatcaaatctcaacagctgaggagaagtaatggaggagaaggtgctgctgatcaaacagaggaggaggagaaggagggaaaagggctcattggtgatttgttgtctatgcaagagtctgctcttttcggccatgaccgagacactgtcatcaaatctgcttgccaggcgttgatcatggctgggagtgacagtacatcagccacattaacatgggttctctctttgttactgaaccatcgtgacgcactcagaaaggctcgagaagaactggatcaagttgtaggaaaggacagacaagtagatgattcagacattaaggatcttgtatatctccaagccattttaaaggaaacgatgcggttatatccagctgcaccgatattagagcgcttggcagtagaggactgcattgtaggtggatttcatgttcaagcaggcacaacactgtttgtgaatgtcagcaagctgcaacgtgacccaaatttatggacggatcctttagaatttaaacccgagagatttctcaccggctgtaacgcggatgtggacttgaagggtcaagattacgagctcgtgccttttggttcgggtagacggtcatgtcccgcggtatcgtttgcagttcgtgtaatgcttttggtacttgcacgcttcattcactcatttgaagtgaagactcgtgaagaagatgggattttggatatgactgagagttcaggtcacaccaattgcaggtctagcccactggaagtcctcatctcaccacggttggattcgaagatctactgttga

SEQ ID NO: 29 - DNA, 1587 bp, Chordyalis celanthifolia
atggagtactactcatcactaccatttcttcaacaatggccactttcatctatatcatcatcaccaacttctattgctacaacacttctcattgtagcttgtttcaccattgttttcctctacataaacaccagttctaagtccaataacaacctgaaatcaccaccgaaacttcccggtgcatggccattcatgggtcacctacatttactaggtggaaaccaaccagctcatgtcagtcttgcaaacatagcagagaagtacaaatcgactcccttcatgatccgaatgggtcaacattcaaccctcgttgttagttcggttgatctcgtaaaggaatgtttcaacaatacaaatgataagctgttttcgaatcgtagtatcgcaagaggaattagagatatgttttacgatatggaatcgtttgggtttgcaccttatggttattactggcgtgaactacgaaaagtatctgcccttactctgttctctactcatcgtgttgattcggttatccaaattaaaacacctcaaatcgacggttggtttaagaaactttacgagcaatgtacgaatacgaaaggcggaattgttgaaataaaatcatggttggatgaaatgatgtttgatgttcttgtgaagatgcttgttgaacctaaggatgaaggatctgtggagaaatacagacatgtagcaggggaggctttggaagtgctggggaatatgagcatctatgatttagtacctagtcttggttggttggatcacttcactgggcttgtgaagaaatataaggtaactggtaagaaaatggacactatcctcaacagttggttagaagaccatcgaggtgagaaagtagctgaggaacacaagggtttaattggtaagttgttgtcaatgaaggaaggatcaaagcttcttggccatgatggagatactgccatcaaatctactgttcaggtgttgatcctaggtgccggcgatagtgcaggagcaactttaacatgggcaatctcattattattgaaccatcctcacataatggagaagcttcggaaagaactggatgcagccgtaggaaaggatagacaaatcgaagactcggatgtgaaaaaattcacttatctactagccatattaaaagaaacaatgcgattatacccggtgacaacgcttctacaacgggaaacgatggaagattgtgctataggtggatatcatgttgctgctggcacaagactgatggtaaatgtttggcaggtgcaacgtgacccgaatgcgtggtcagatcctttggagtttaagcctgagagattcctaactgagtgcgcgcatgtggatttctcgggtcagtattctgagcttattccattcggaacaggtcgacggatatgcccagctcttacgctatcggttcggctcatgttattgacccttgcccgtattatccattcgtttgatgtgaaaattcctaatggggcatcgagtgtggatatggcaacaagcgtaggttttgttaatctgaggttgaccccacttgaagtcgaactctcaccacgcttggattcaaagatctacggttga

SEQ ID NO: 30 - DNA, 1614 bp, Chordyalis celanthifolia
atggattcctctcttcttcaatggtacacaacagcttcaatggctgcccttcttgccttagctttcttctacaaactctggagtaagccaaggacttctaaaaatggaaaaagtactttgcaggcaccagtagcagctggtgcatggccagttcttggtcaccttcatctgtttagtggaggtgagttaccacacaaaatgttggctgccatggccgacaagtacggccctgccttcacaatgaagttcggtacacaccgaacccttgtggttagtgacacaaagattgtaaaggaatgtttcactaccaatgatacgttatttgctaaccgtccatccaccatggcctttcatctcatgacctatgacaatgagtcggtagccttcacaccatatggtcaattttggcgtgagttgagaaagatctccacactcaaacttctttctaaccatcgccttcaggcaatcaaagatgtacgtgcctcagaggtgaatttttgctttaggacgttgtacaaccaatggaggataaataaaagtgagactatcggaaccggtgatcatcaaggaccaattttggtggatatgaagaagtggttcgaagaagtgtcaaacaatgtggtgatcagagtaattgtaggcaaacataactttggatctaagatcgcccgcggaaagggagaagcccttcactacaagaaagtcatggacgaggtcctacgtctagcggcagtgtccatgctctcggatgtggcccctttacttggttggttcgatcatttgcaagggcatgtaagtgcaatgaaacgaaatgcaaaagaagtagacactttgctctgtagttggatggaggaacatcgaaaaaagagaacctccaacggcagtaatggtgtagagcaagatttcattgatgtcatgctgtccatcgtggaggagaacaagttctctgggcatgacagtgacactgtcatcaaagctaccgtcttggccatgatcatgggtgggactgatacatcagccgtgagcttaacttggattgtctccctgttgatgaacaatcgccacgttttgagacgggcacaagaagaacttgacacacatgtgggaaaggatagacaagttgatgattcagatctcaagaacttggtttatctcaatgctatcgtcaaggaaacaatgcgtttgtacccactaggcgcccttcttgaacgggaaactaaggaggactgtgaggttggcgggttccatgttaaggctggcacacgtctattggtgaatgtatggaagctacaacgagacccaaacttttggattgatccaacagaatttaaaccagagagatttttaactgacaacgcaaacatagatgttgggggtcagcattttgaactgctaccatttggtgccggtagaagagtgtgccccggagtctcattcgcattgcagttcatgcatttggttcttgctcggctaattcatgggttcgaattggatacccctatgaatgcaaatgtcgatatgaccgaaagtacagaagggcatgtcaaccataaagcatccgctctcgatctccttatcacaccacgcctccggtctacactttatgattattaa

SEQ ID NO: 31 - DNA, 1716 bp, Chordyalis celanthifolia
atgttcaagtctgttccaagtgcacaggcaattttacwyaarctttcattcatccaccagtacttcctgctctctcaaacaaatatggattcccttctttttcaatggtttccagcttcaatggctgcccttgttgcctttgcttttctttataagctttggagtgcacccaaaattaccaaaaatggaaagacaagtactaaacaggcacccatagcagccggtgcatggcctgttcttggtcacctccatcttttcggtggaggtgaattgcctcacaaaatgcttgcaggcatggctgaaaaatatggtcctgccttcacaatgaaatttggtatgcatcgcacactcgtggtcagtgataccaagatcgtaaaggaatgtttcactacccacgatactctctttgctaaccgtccatctaccacagcttttcaccttatgacctacgatcaagagtcggtggccttcaccccttatggtcctttctggcgtgaactacgaaagatctccacgctcaaattactttctaaccaccggttacaagcaatcaaggacgttcgaacctctgaagtaaacgtttgctttagagggttatacaacatatggcaaaccaacaaaaatgagcaaggtggtactgttagtgatcatccacgccccgttttgattgatatgaagaaatggttcgaagaagtttcgaataatgtggtgattagggtgattgccggtaaacaaaactttgggtctaaaattgtacgtggtgaagaggaggcagtaaaatacaagaaaatcatggatgaagtcctacgccttgcggcagtatctatgctttctgatgtagctcctttacttggttggttagatcttttccaagggaacttgagtgcaatgaaaagaaacgcaaaagaagtagataatatgcttaatgcttgggtggaggagcatcgaagaaagaggctcgcacatagtgctaaagttgaggctactcatgtagaacaagactttgttgatgttatgttgtccatcatggaggagaacaagctttcatcagtccacgacgatgacactgtcatcaaagccactgtgttggccatgatcatgggtgggactgataccacagctgtgagcctgacctggacagtttccttgttaatgaaccatcgttatgtgttgaagaaggctcaagaagaaatcgatcaacatgtgggaaaagaaagacaagttgaagattcagatcttaagaacttggtttatcttaatgccattgtcaaagaaactatgcgtatgtacccgttgggtgctcttcttgaacgtgaaaccaaggaggattgtgaagttggtgggttccatgtcaaaggtggaacacgtctattggtgaatgtttggaagttacaacgggatccaaatgtttggattgatccaacagaatttaagccagagagatttttggcagagaatgccaacatagatgttgggggtcagcattttgaactgctaccatttggtgctggcagaagggtgtgccctggagtttcattcgcactccaattcatgcatttggttcttgctcgcttaattcatggatttgaattggaaaccccaatgaatgccgatgtcgatctaactgaaagtaccgaaggccatgtcaaccacaaagctagccctctcgatctgctcatcgccccacgactcaactcgaagctttatgaattgtag

SEQ ID NO: 32 - DNA, 1602 bp, Chordyalis celanthifolia
atggattccttgtttgttcttcttcaatggttctcagcttcattggctgcagttcttgctttggcttttctttataacctatgggttaagccaagaattagtgatggtaaaggaaataaagggagtactaaacaagcacctgttgcagccggtgcgtggcctgttctcggtcaccttcatctctttggtgggagtgaattacctcacaaaatgcttgcagccatggctgataagtatggacctgccttcacaatgaagttcggtacacatcgaacacttgtggtcagtaacacccaaatcgttaaggaatgttttactaccaacgatacacacttttccaaccgtccgtccaccacagcttttcacctcatgacttatgacaacgattcggtagctttcacaccttatggtccattttggcgtgagttgcgtaagatctctaccctcaagcttttatctaaccaccgtcttcaggcaattaaggatgtacgtgtttccgaggtgaatgtttgcttcaaggatctatacaatcaatggaagacgaatcaaaaccaacgtccggtcttggtggacatgaagaaatggtttgaagaagtatcaaacaatgtggtgattagagtaattgtggggaaacaaaactttgggtctaagattgtgcgcggtgaggaggaggctgtcaaatacaagaaaatcatggatgaaatcctacgccttgcggcagtgcctatgctttcggatatggcccctttacttggttggttggatcttttccaagctcacaagagtgcaatgaaacgcaatgcgaaagaagtagacaacatgcttgaaagctggctggaggagcataaaaggaaaagactatctggtgtaaatggtgcagaggaggaagatttcatggatgttatgttgtcaatcatggaagagaacaagttcactggacgtgatagcaatactgtagtcaaatctactgtcctagccatgatcatgggtggaaccgatactacagccgtgagcttaacttggattttctccttgttaatgaacaaccgtcatgcactgaaaaaggcacaagaagaattggatatgcacgtcgggaaagacagacaagttgaagattcagacctgaaaaacttagtttacctcaatgctatagtcaaggaaaccatgcgaatgtacccactaggtgcacttcttgaacgtgaaaccaaagaggattgtgaggtaggtggataccacgtccgcgcaggcacacggttgttggtgaatgtatggaaactacaacgagacccaagcttttggactgatcctacagaattcaaaccagagagatttttaaccgagaacgcaaagacagatgttggtggtcaacatttcgagctactaccatttggagcaggtagaagggtatgtccaggagtctcatttgcacttcaattcatgcatttggttattgctcgtttgattcacggttttgaattgggtactccaatggatgccgatgttgacttaaccgaaagtactgaagggcatgtcaaccacaaagcaactccactcgatctcctcattgccccacgcctcgactcaaaagtttatgattactaa

SEQ ID NO: 33 - DNA, 1593 bp, Chelidonium majus
atgaggagtaattacttaaagccgacgacgacgacgatcgaggataaaagtaagaacaagataagcaggaagaagccaatagcagcaaaaccaccacctgaagcattgggcgcatggccagtgatcggtcactttcttctatttacagggaaagggttgactcatgtgactctaggagacatggcggataaatacggaccagcatttcttattcggttcggtagccatagaacacttgtggtgagtagttgggagatgatgaaggagtgtttttcggcccctaacgataagatcttttcaaaccgtgaatccaacttattatggattaagtcaatgttctacggttccaattcatatgggttctcaccttatgggccatactggaaggagctacgcaagatatcgacccaaaagcttctctcccaccaccgacttgatgcgatgaagcacttgcagatggtagaagttgatgcctcatttaaacagatttacaatttatgcaacaaaaatggaggttcaccatcacctagtagtattaatactactgctctggtgaacatggacgaatggttgtcacacctgatgttcaacgtgatagcaagaatggtcagtggataccaatccgatgatgtcgggacaggtgctacgagtactggggaaagattcaaggtttccatggatgagacgatgcgtcttatggccattttcgctgtttcagatttggttccatggcttgcatgtgtggatcgattaagaggccttacgagaaaaatgaaccgttgtggtaaggatttggactcgataattgggagactaatcgaagagcatcgtcaaaagagacgattatgcagaaataataaaggatcaaaaaatgaagatggcggtcatgatgatgatcaagacttcattgacatttgcttgtcaattatggagcaatctcagcttcctggcgataaccctgaaattgccatcaaatccattgtgctagacatgatatttgctggaagtcacaccacgactctggcaatgacgtggaccctctccttattgttgaaccatcgccacatgttgaaaaaagccaaggaagaaatagatgcacacgtgggtaatgaaaggcaggtggatgactcagacatccataatcttgtgtacattcaagccatcatcaaagaatccatgcggttgtacccgcccagcccactgttcgaacggatgacaatggaggattgtgaggtaggtgggttccacattccagctggcacacgcttatttgtcaatgtatggaagatgcaacgagacccaactgtgtgggaggatccattagagtttcgacccgaaagattcttgacgagcaagagagagatagatgtgaaaggccagcattatgaactcataccgtttggtgcgggtaggcggatatgcccgggcgcgtcatttaccttgcaggtgttgcatttggtgcttgctcgccttatccatggcttcgaaatgacgacgcccatggatgtaaaagtggacatggcgtcaagtgcagggctattcagtaacaagatgacgcctttggaagtgctgatcacaccacgtacagcctag

SEQ ID NO: 34 - DNA, 1674 bp, Chelidonium majus
atgaagatattgcaggagtttcatcaactcaccatttccaatattgttcttcttctacttatttctttcatctttttctctcttagtgcatggttcattgagagtactaattattattacagtagtaagaagaagaagagcaaaaagacaccaccacctgaggcatcgggtgcatggccagtgataggacaccttcatcaatttaaaccggacgatttacctcatgaggctcttggagacatggcggataagtacggtcctgtttttattgttcgattcggtagttatagaaaacttgtggtgagtaattcggagatggttaaggagtgtttcacggccgcaaacgataggtccttttcgaaccgtccggccgtcttagggattaggatcatgctctataacaccataacgtatgcgttcgcaccttatggaccgtactggagggagttgcgtaggatatcgtcgcagaatctcctctctaaccatcgagttgatatggtaaagcacttgcatgtcgatgaagttaataccttgtttaaacaactttacgagttatgcaacaaaaatggaggtcgaccccctactggtactaatactagtactagtgctgctctagtgaacatggatgactggttgtcaaacataatgttcaacgtgatagcaagaattgtcaatggaaacaacaaatccattaataatgagaggacaggtgccataaatgagaaaagatacaaaacagctatggatgaggcgaggcgtcttgtggcaatttttgcagtttcagattcagttccatggcttggatggttggatcgagtgagaggccttataagaggaatgaacctttgtggaaaggaactagactcaattattgaagatataatcgacgagcatcgtcaaaagagacgattatgcacaagtaaattaggatcatcaggagatgatgatgctgataatagtaatcttgaggaagaagataacttcattgatgcgtgcttgtcgatcgaggagcaatcgcagttacctggcgaaaatcctgaaatcgtcatcaaagctttgatcctggacatgtttgctggtggaagtgatggcccacattttgtgttgacgtggaccctcgccttattattgaaccacccccacgtgttgaaaaaggcaagagaggaagttgatgcacacgtggcaaacgatagacacgtggatgtctctgatatctctaatctcgtctacatacaagcaatcctcaaagagtcaatgaggttgtacccgcccaacgcactcattgagcgaatgacaacagaagattgtgaggtaggtgggtaccacattccagctggcacatacctattggttaacgtatggaaggtacaaagggacccgaccgtgtggcaggatccctctgagtttcgacccgaaagattcttattaacaaacacaaaaacggagatggagtatgaacatataccgtttggtgcgggtaggcgaagatgcccaggaatgaggtttgcattgcaggtgatgcatttggtgcttgctcgacttattcatgaattcgaaatcacgacacccgtggatgtaataaaagtcgacatgacggcaactaatgggttattcaatcacaaggccgtgcctttggaagtgctactcacaccacgtactcttatccgaggttag

SEQ ID NO: 35 - DNA, 1626 bp, Chelidonium majus
atggattattcagtccttctccagtacggctggtttgctccttccatggctgcccttcttgccttagctttcctttacaatctctttttggcttcatctccgaaagctactagcaagagaacaataagtacaaagaaaccgcccatggcagccggtgcatggccaattcttggtcatctccatctgtttaaagagggtgagttgcctcaccaaatgcttaaatccatggctgacaagtatggtcccgccttcctcatgaagttcggccaacaccgatccctagttgtgagtgactaccgcatcgtaaaagaatgttttactactaatgatacccacttttgcaaccgtccatccactacagctttcgatgtcatgacttacgctaatgaatcggtagctttcacagaatacagtccttactggcgcgagcttagaaagatatccactctcaaacttctctctaacaaccgtctccaggccatcaagaacctccgagaagaggaggtgaatgttagcttcaaggggttgtatgattcatggaagaataagaacaacaagagtaccggcagtgttggtgatgaacgagctccggttttggtcgacatgaagaaatggtttgaagaggtgtcaaacaatgtggtgattagggtaatcgtgggcaaatgtaattttgggactaagatcgtgcaaggtgagaaggagggtgtagagtacaagacaatcatggatgagcttttacgacttgctagtttgtctttgttatccgattttgcccctatacttggtttgttggatttcttccaaggtcatgtccgtaccatgaaacgaaatggcaagaaactagacgtgttacttcagaggtggttggaggagcataagaggaagaagagcacaccagaggatgagcaagacttcatggacgttatgctgtcggttattgaggagagcaagctttctggctatgacgctgataccgtcattaaagctacttgtctggccatgatcatgggtggaacagacacatccgcagtgagtctaacatggatcgtctctttactgatgaacaatcgtcatgcactaaaaaaggctcgagaagaattggacgcgcaggtggggaaggatagacaagttgaagattcagatctaaagaacttggtttacttgaatgccatcgttaaggaaacaatgcgattatatccactaggtactcttcttgaacgcgaaaccaaggaggactgtgaggttggtgggtttcacctcgaaggtggtacacgtttactagtgaacgtatggatggtacaacgagacccaagcgtgtggactgatccgacaaagttcacaccagagaggtttcttacggagaaggcagacatagatgtttggggtgggaattttgaacttataccattcggagcgggtagaagggtgtgccccggagtgtcctttgcacttcaattcctaaatttggtactagctcgtctcattcatggatatgaattgggaactccagatgacgcggatgtggatctaacggagagcccagaaggacatctcaatcacaaagcatcacctctcgagcttctcctcaccccacgcctcagtaaccctaagctctatgattattag

SEQ ID NO: 36 - DNA, 1614 bp, Chelidonium majus
atggagtttctctctctagaaccccaactaatttccatttttgttcttcttcttgcttcatccatattcctctacaatctcttgaagaatcatggaaggaaatccaagacctcaaaaccaccagcacctgtagcatcaggtggatggccaatcatgggtcatctccatcttttcaatggaagcgagttaactcatcaaactctaggttccatggctgacaaatatggtccagctttcaatatccaactcggttctcatcaaacactcgttgtgagtagttgggagattgttaaagaatgtttcactacaaacgaccgattcttttcgaatcggcctggatcgttagcgattaaactcatgttctacgacgctgattcagttggttacgcaccgtacggtgcttactggagagatcttagaaaaatctctacgttaaaactcctttcgaatcatcgagtggaaaccctaaaacatttgagaacttctgaagctgaatcatgttttaaacaactgtataatcagtggaagaacaacaaagttggcggcgacgacgatgaatttgctatagtgaggatggataattggtttggagacttgacatttaacgttgtggcgagaattgtcgccggaaaaaagaattttgctggaggtgcgacgagtggcgacgtcggagctaagagatataaggaagctatggatgaagcgttccggttaatgacgattttcgcgttctcagatgtggttccgtcgttaggatggttggataaattgagaggtttggttggagggatgaagcgttgtggtgcggaaattgattccattgttgggggttgggtggatgaacatagattgaagagagcttctagaaagggaggagatcataatgatctcgatcttgaacaagattttatagatgtttgcttggagattatggaacattctactttgcctggtgatgatcctgaaattgtcatcaaatctacttgtctggacatgattttgggtgggagtgacacaacaacggtgaccctaacatgggcactctccttactattgaacaatcctcacgtattgaaaagggctagggaggaattggacacacacgtcggaaaggacagacaagtagacgactccgatatgtctaatcttgtgtacatccaagcgatcatcaaagagacgatgagattgtacccagcaggaccactgatcgagcgaaggacatcggaggattgtgaggtcagtgggttccatgtaccggcgggcacacgcttaatggtgaacttatggaagatgcaacgagatgggagcgtgtataaggaggatccattggagtttagaccagagagattcttgactagcaatgctgatgttgacctaaagggacagaattatgaactgataccatttggtgcgggtaggaggatatgtcctggtgtgtcgttcgcagtgcagttgatgcatttggtgcttgctcgtcttgttcatggctttgaaatgaagacggccggaggtgcaaaggttgacatgacagaaagtgcaggactaattagccacaaggttacaccgctacaagtgctgctcaaaccacgccttgcgatccaacaagctttataa

SEQ ID NO: 37 - DNA, 1653 bp, Chelidonium majus
atggattcgatgaacctgtttcaacaagcgattgcagtaggtacccttgtcatcttcctctactatctatggaagtggacatcaataatattcactcgaactcaccaggcggcgccaccagaacctgccggagcatggcctattataggacacctccatctcctagcaggaggagcaaaccaactcgtatatcacatacttggatccatggctgacaagtacggcccaattttcacggtccgactcggcatgcgacgagccttaatagtgagcaactccgagttagcaaaagagtgtttcaccaccaacgacagaatcttttccactcgccctagttcagtagctataaaattgatgggctacgattcagccatgtttggcttcgcaccatacgggccttactggcgggagatgcgcaagatagcagtaactgagcttctctctaataggcgcctcgagatacttaaaaatattaggatctccgagatcaacatgtctataaaagatttatatcaactctgggttgagaataagaacagtggtgttgatggcggcggtgacggtggtgaggtggtggtgggatcaccggttttggtggagatgaagaggtggtttgaagatgtgtcgttcaacgtggtggttaggatggtagctgggaaaagatatttcgggagaagggttgaaagtgatgatcgtgaagaggaggaggcgaggaggtggcagaaggcgatgaatgattttatgcatttggtggggattttcgtggtgtcggatgccattccatttttagggtttttggatttccaaggatatgagaaggagatgaagaagacggcggttgagattgattatgttatgggaagatgggttgaggagcaccaacggcggaagctggagagggtggcggggggatctgatgatcaacaggaagatttcatagatgtgatgttgtcgatcttaaaagatggtgatcagttctatggttatgatcctgatacggttattaagtcttcatgcctgtctcttgttttaggtggtagcgacacaatatcagtaacactaacatggacggtctccttactgctaaacaatcgcaatgtgttagaaaaagctcaaagtgagttggacatccacgtaggcaggggaagacaagtggacgaatcagatatcaacaatcttaaatatctccaagccatcgtcaaagaaaccatgcgtttatacccagctggaccactatcagcaccaagagaggctatggaagactgcaccatagctggattccatgtccctaaaggcacacagttgatgctcaatctatggaaattgcatcgagaccctcgcgtttggtcggatcctttggagttcaaaccggagaggtttcttactactggcacccatggagatgttgatgttaaaggacaacatttcgaattattaccgtttggagctggtaggcggatatgcccagggatatcttacgcccttcaagtcttgcatttgacccttgctcgtcttcttcatagttttcatttatcaacgccatatgatatccccgtcgatatgactgaatcttctggactttcttgcccaaaagcaactcccttggatgtcctccttacacctcgtctcccttcagagctttatgtgtcttaa

SEQ ID NO: 38 - DNA, 1686 bp, Chelidonium majus
atggatttgttcatcttcttcagccggttccaatatattgtaggattattagctttcctgaccttcttctattatctatggcgggtttcaattacaggaacaaggatcaaaaccaaccaaaacatcatgaacggcaccaatatgatggcaccggaagctgccggtgcgtggcccatagttggtcatcttcctcagctagtaggccctcagccactcttcaagattcttggagacatggccgacaagtacggttcgatattcatggttcggttcgggatgcacccaaccttggttgtgagcagttgggaaatggcaaaggagtgcttcactaccaatgacaagttccttgctagtcgtccaactagtgctggaggcaagtacctcacctacgactttgctatgtttggcttctcattttatggcccctattggcgtgagatccgtaagatctccacgctcgaactactatcccatcgtcgcgttgagttgctcaaacatgtcccttacactgagatcggcggctctatcaaacaactttacaaactttggatggaaacacaaaaccaaaataagcaacgggatgatcatcaggtaaaggtcgacatgagccaagtgttcggatatctaacattgaatacagtgttaaagctagtggtaggaaagggtctattcaacaacaatgacatgaatcatgaacaggaagaaggtcgaaagctccacgagacagtacttgaattcttcaaactggcaggggtctcagttgcatcggatgctcttccattccttggctggctggatgtagatggacagaagagaagcatgaagaggatagccaaagaaatggatttaatcgctgaaagatggcttcaagagcatcgacagaaaagactaacatcaaacaacaaggctagcagcggccatgacgacttcatgagcgtgttgctatccatccttgacgacgattccaatttcttcaattacaatcgtgatactgtcattaaagccacctctctgaacctgatattagcagcttcagacactacatcagtgtccctgacttgggttctctcgttattagtcaccaaccccggtgccttgaaaaaggtccaagatgaactggatactaaggtgggcaggaacagacatgtcgaagaacgagacatcgagaaactggtctacctccaagccacagtcaaggaaactctacggatgtacccagctggtccactatcagtaccccacgaagctacccaagactgcaccgttggtgggtatcaggtaacagcaggcacacgtttggtggtgaacgtgtggaaattgcaacgcgacccgcgtgtgtggccaaacccatctgagttcaagccggagagatttctaccagacgggtgtgaggttggttgtggtgaagcagcaaatatggatttcagaggacaacattttgaatacataccatttgggtcaggaagaaggatgtgtccagggatcgactttgccatacagatcatacacatgacactggcctgcctactccatgcattcgagttccaggtgccctcatcactagataaacatcttgtacctgcagtaatcgacatgagcgaaggttcaggactcaccatgcccaaagtaaccccacttgaagtcctccttaacccacgcctacctcttccgctttatgagttataa

SEQ ID NO: 39 - DNA, 1569 bp, Cissampelos mucronata
atggaggccatgggtgaatattttcagcttatttcatggactgtgttttcggctttgatcaccatctactttatattcagtaggaagactaatggaaaaaagaaggcaccggaaccaggtggtgcatggccgattattggtcacctccatctttttggagctcatgacctgttgtaccgaaagcttggggccatggccgacaaactcggcccagtattcatgatccgttttggcatgcatcgagccgtcgtcgtaagtaactatgaagtagcaaaagaatgcttcactgtcaacgataagatactcgcaagtcgcccacggattattgcttcaaaactcatgggctacaaccatgcggccgttggattaagcccttatggcccttattggcgagaggcacgtaagatagccaccttggaacttctgtctaaccatcgactccaactactcaagcacatcaggatatcagagattgatatgtggataaaagagctaaaagaattttgtatgaaaagcagtagcgatggtccagttcttgttcaattagatggatggttcaatgctttgacacttaatataatggttaggaatatagccggcaagcgatattgtggcggtgctgaagcctttgaagatgaagagtcgcagcgatggaagaaagtttctagagaacttatgttcttgttcggagtctttatggtacccgatgcatttcctgtactggaaggcatagatgtgcagggtttcgagcgagccatgaaaagggttggtaaggaaatggatttcttcttgagtcgatggttggaagagcatagaaggaagaaaatagaactctccgagaaaggaaacgaagttaatgatcaaggagctcaagatttcatagacgtgatgctgaacacaatcaaggatgccaagatctttgagcatgacgctgatacgatgatcaaagccacttgtatggctctagttgtagcagggaacgacacgacaatgatcactctatcatgggcagtttcattgttgctgaataatcgtggagttttagagaaagcccaggaggaattgagcaaccagataggaaaaaacaggcatgttgaggaaggagacatcgagagcttgccttaccttcacgcaattgtgaaagagaccttccggctataccctgctgcaccactttcattaccacatgaagctatggaagattgcaccattgccggctttcatgttcctgcaggaacacgcttgattactaatatttggaagctgcataaagatcctaatatttggcctgacccattggagttcaagccagagagattcctcactactcatgcccatgtcgattttaaaggtcaacacttcgaattcatccctttcggatcaggaagaaggatgtgccctggatcgtcgctagcaatcagtgttttgcacctcacccttgcacgtttgctccatgaattcgagcttaaaactccggatgatgcaccggtggacatgaccgaaggtccgggtatcacactcatgagagcaaacccccttcacgtgctcattaatccaagacatgactga

SEQ ID NO: 40 - DNA, 1605 bp, Cissampelos mucronata
atgtcctcgcccatccaacaactactcctctccttgacctccattaatggcggaaccatcatctcagccgtcataatatcactccttctcatcctcacccttcatcgcctcctaaaacccattaattccaacaaaaccaaacaccctccaagagcatccggggcatggcccgtcatgggccacctccacaagctccgcgggccggacctcccccaccgcaccctctcatccatggccgaccagtacggcccaatcttcacaatcaatctgggccccaccaccgccctcgtcatcagcgacccagccgtcgcaaaagagtgcttcaccaccaacgacctcaccttctcctctcgaccgaccactctcgccaccactctcatgtgctacaacaacaccatgttcgggttcgccccgtacggcccgtactggcgcgaagtccgcaaggtcgtcatggcccaactcttatcaacccgtaggctcgagtcactcaaaaacatttgggcctcggagattgaccgctgggttaagggcctggcccaaaaggcccaaagtgggtcgcatggtgtggttgaggtggagatgggtgattggctggcgaggttgactatgaacattgggctaaggttggtcgtggggaagagttgtggtgagatggggagtgaggagtcggagaggtgcttgggtgctatgcgggagtatccggagttgctgggtcggttcgcgttggaggacgcgttgccgtggttgggtcggtttgatttgcaagggcatcagagggagatgaggagggctgcgagggtcttggatgagattcttgatgggtggttggatgagcataagcgaaatagatcggggttaagtggtggtgatgatcatagggatcaggattttatggatgtgatgttgtctgttcttgaacaagatcaagattcgagtcttagcgaccatgatgctgatatgatcaacaagtccacttgcctgaatctaatcttaggcatggctgataccacaatggtggccttaacatgggccatttctcttctcctcaacaacaaaacgtccctcaagaaggcccaagaagaattacaagcccaagttggcaatgaaagacacgtggacgaatctgatgtcaagaacctagtctacctccaatccatcataaaagaagtgttgaggctttacccaccagagccactatcgggcccacgagaggcccttgaagactgcgaggtggcaggataccatgtcccgcgaggcactcggcttatcgcgaatttgtggaagatccatcgtgactcgtccacgtggcaggattctatggagtttcgaccggaaaggtttctgacggcccacgaacacgtggatgtgtggggccagcacttcgagttcatgcctttcgggtcgggtcgaaggtcgtgtccgggagtctcgtttgaggttcgggtgttgccattgatactggctcgtttgatacacgcattcgagatgacgacacgtggagatgtgccggtggatatgagtgaaagaccgggccttgttatctcaaaagcaagcccacttgaagttatgatttctccgcgcttgccccttcacttgtttgaataa

SEQ ID NO: 41 - DNA, 1611 bp, Cissampelos mucronata
atggagtttcatttgcttctccaagcagttgcagcaactctagtgaccttcttcctttatgagctatgggctctaaggaagaagttcagcaggcttaccaaaactccctcatcaaaggctttgctcaaagcaaagtgcgcaccagagccgcccggtgcgtggccgatcatcggtcaccttcctttgctggtttcagccaagcagcctcatcgggcatttgctgcacttgctgagaagtatggtccagctttcatgctccgcatgggcatgagtcctatgctgattgtgagtaccaaagaggttgccaaagaatgttacaccgccaatgatcatgtgtttgctactaggcctgtcaccaccgctgggaagctcatggcttatgatcactcggtcatgggcttcactccttttggaacctactggagagaaatacgaaagatcgcgacggtggagctgttctcggctcgcaggatcgggatgttgaagccggtaagacagtctgaggtctcgttgtggatgaagggattgcatgagaagtgggtgcataatggaaatagctcggtctccgtggagctgaagagtcaactggaagaactcactttcaatttgcttacacaaatggttgccggaaagcgttactacggaagtaacgttgcaaaggtggatgagaagatggcggggctatttcgccacgccgtccaacaattcaattatcaccttgggaactcggagatgtatgatgccttgccattcatggcatggttggacttcaagggcgacgccaaggccatgaaaaagacacaaaaggacttggattttattatgcagacttggttggacgagcaccgcctaaaagcggatcaaatgcgcggggacgccatcaacaacaccagagacttcctcgacgtgctggtgatgatggagaagaccggccaattttcatcggcaattaaagacagagacactacaattaaggccttggctctgacccaactagtagccggagtggacagcatggccaacacaatggtgtgggtgttggctctcctaatgaacaacccagaaatgctagccaaagcacaagacgagctcgacaacaacgttggcaaagacagactcgtggaggagtcagatatccctaatttgaagtacttacaagccctcctaaaggagaccctccgaatgtaccccgtggggcctttgttggtgccgcacgaggcaacggaggattgccacgtggccgggtattttgttccacgtggaactggcctgttcatcaacgcttggaccatacaacgtgacccaaatgtatgggctgagccgaactgttttaatccagagaggttcttaaccactcatgcagagatggacgtgaagggtcaaaatcatgagctgttgccattcgggtcgggtaggcgatcgtgcccaggtgtgggactggccctccaagtgatgcacctcaccttggctcgaatattacaagcgtttgagttgaagactcaatcgggtgttggaattgacttggaagagtgctccggcatactgctttccatgatgcacccattgcaagtgatgatggcacctcgccttccttccgaactctatgattga

SEQ ID NO: 42 - DNA, 1575 bp, Eschscholzia californica
atggattccttaatccttaccaattggtttccaatatcaattgcttctgttttaaccctagttttcctttacaaagtcttactttcctcaagaactcttaaagataagaagattaagacttcacccatggcaaatggtgcatggccaattcttggtcatctccatctctttggttcaggtgaattacctcataaaatgctagctaccatggctgacaagtatggctcagccttcaggatgaagttcggtaaacacacaacactagttgtgagtgatacccgtatcgttaaagaatgtttcactaccaacgataccctcttctctaaccgtccttccactaaagcttttcaactcatgacttacgataatgagtcggttgcctttacaccttacggtccttactggcgtgagcttagaaagatatccactcttaaacttctatccaaccatcgtctccaagccatcaaggacgttagagcctcggaggtaaacgtatgcttcaaaagcttatacgatcagtgtaaaaatccaagtggagctcctattttgattgatatgaagaaatggttcgaagaggtgtcgaacaacgtggtgatgagggtaattgtggggagacaaaactttgggtctaagattgtgcaaggtgaggaggaagctatccattacaagaaggtcatggatgagctcttacgtctcgctagcttgtctatgttctcggattttgctcctttacttggtttcttggacatctttcaagggaacttgagtgccatgaaacaaaacgccaagaaggtagacgcaatccttgagaactggttggaagagcatcggaagaagaagaactcagttgctgaaagcgagcaagatttcatggatgttatgttgtcaattgccaacgagagcaagttgtctggtcacgatgccgatactgtcattaaagctacttgcctagcaatgattatgggtggaacagacactactgctgtaagtctaacatggatcatttctttattaatgaacaatcgccatgctttgaagaaagctcgagaagaattagatgcactagtaggaaaggacagacaagttgaagattcagatttaaagaatttagtatacatgaatgctatcgttaaggaaacgatgagaatgtacccgttaggtactcttctcgaacgcgatactaaggaggactgtgagatcggcgggttccatgtcaaaggtgggacgaggttgctagtgaatgtgtggaagttgcaacgagacccaaatgtatgggttgatccaacagaatttagacctgaaagatttctaaccgagaatgcggatatagatgttggaggtcagcattttgagttgctaccatttggagcaggacgaagggtgtgtcctggggtgtcgtttgcactacaatttatgcatttagtacttgctcgtctcatccatggatacgatttgaatactctaaacgaagaaaatgtggatctgacggagagcccagaaggacatgtgaaccacaaagcatcgcctcttgatctcatcctcacccctcgtctacattacaagttgtacgaatag

SEQ ID NO: 43 - DNA, 1599 bp, Eschscholzia californica
atggatactgcttcatcaatttcccttctcctcccttgggcagtagtagttccctccatagctacccttcttgctttgctacttttcctcttcatcacttcaccaaaaacacccaagaggaaaacaagttcaaaaccaccacccactgttcttccaggtgcctggccaattctaggtcatctccatctctttaaagaaggagaatcacctcaccacatgcttaagaacttagctgataaatatggacctgctttcgtcatgaaattcggacaacatcgttccctagttgtaagcaacactaaaattgttaaagaatgttttactactaatgacaccctcttttccaaccgtccatctactactgcctttgatctcatgacttatgctcatgactcggtagctttcacaccttatagtccttactggcgcgagctaagaaagatatcgaccctcaaacttctatctaacaaccgtctcaaagcaattaagaagctccgaggagaggaagtggacgtttgttttcgtgggttgtacggtttatggaagaataaaactaaaaatggtgctccagtcttggttgacatgaaaaaatggtttgaagaggttgcaaataatgtggtgattagagtgattgtggggaaacttagttttgggaccaagattgttgatggtgaagaagaagccgttgaatataaaacagtcatggatgaactcttacgtcttgctagtttgtctttgttatccgatatggctcctatactcggttggttggatttcttccaaggaagtgttcgtaaaatgaaacaaaccggtaaaagactagacgttttacttgagaaatggttgggggagcaccgagagaagaagaacttggttggggaagatgagcaagatttcatggatgtcatgttgtcgatcgtggaagaaagtaagctatctggccatgaagctgatgccgtaattaaagctacatgcttggccatgattatgggtggaacagacacaacagcagtaactctgacatggatcatctccttattgatgaacaatcgtcacgcactagaaaaagctagagaagagttggagacgcacgtcggaaaagatagacaagtggaagatacggatttgcagaacttggtctacttgagtgctattgttaaggaaacaatgcgattgtaccctttgggtactcttctcgaacgagaaactaaagaagactgcgaggttggagggttccacatccaaggtggaacgcgtttattggtgaatatatggatggtacaacgagaccccaccgtatggaatgacccgtcggcatttaaaccagagaggttcttaacagataaatcggaaatagatgttgggggtcaacatttcgaactgataccatttggggctggtagaagagtgtgtcctgccgtgtcgtttgctcttcaattcttgcatttggttctcgctcgactcatccatggatatgacttgggcactccaagcaacgtggaagtagacttgactgagagcctggaaggacacgttaatcataaagcatctcccctcgaactcctcctcactccacgcctcaacccgaagctttattaa

SEQ ID NO: 44 - DNA, 1647 bp, Eschscholzia californica
atggaatctgagatccaatatcaaactgcaacaatggcttccattcttagtactaatttgattctaagcagtatttttactgcttttcttctctatttcttactaaagatgagtccatttaggtcatcaaaaaacaagtcaagaaagcaagcaccaaaaccaactggttcatggcccattataggtcatctccttcatctccaaggaccaaaccttcctcacataaacttagcagctttggctgataagtatggatcagtgttcagcttccgtattggtctccgtccagccctcgttgtcagttcttgggagatagctaaagagtgtctaactacaaatgatagagtcttcgtctctcgcccgccgttaatagctatgaaacacatgggttatgaccacgccttgttcggattctccccttatggtccatactggcgcgaactccgtaaactagtgaaccaagaacttctttcgaacactaggattgagttgataaaacatgtttgggatactgaaataaatacattcattaatgacctttatgaagtttgggctatgaaaagtaatgaaggtgggggtgatgttgtggttgaaatgaagcaatgcttgtacgattttactctcaatctcacactaaaaatacttaccggaaaacggtatttcggtggtggtggcagcgaagagttaagagaagaagcaggaagatgtcaaaaagcagtaagaaactttcttaggttagtgggtacttttacagctcaagatgtcattccatttttggaaggttggttagacttgggtggtcatgagaaggagatgaaaattacaggaaaagaactcgactccctacttcaaaaatggttagaagaacataaagtaaagaaatcgtcagctggggaagaaggccaggagaatcgaggtggtgatgaagaagatttcatgggggtgatgcttacaaaacttcgtgatcacgagaagcttttaagttattacgatgctgatactatcaacaaggctacttgcttgactgtaatcctaggtgggagcgacaccacgatgatgactctagtatgggctctcgctttactagtaaatcatccgcatgtaatgaagaagctccaagatgagttggatacccacgtaagtaaagaaagacaggtggaagaatcagatatcaagaacctcgcgtatcttcagtctgttatgaaggaaacaatgcgtcgttacccagggacccctctatatgttagagaatcgatcgaggattgcactatagctgggtacgacgtcccaacaggaacccgtcttgtagtgaatgcgtggaagatccaacatgacccacaagtatggtctaacccattcgagttcaatccagagagattccttacaacccacaaggacatagatgttagaggtcagaatttcgaacttatcccatttggagcaggcaggagaatgtgccccggggcttcactcggtcttcaagtggtgcacctgactctggctcgtctagtacatggatttgagtttaaaacaccagatggcgaacccatggatatgacggagagtataggactaactaatcttaaagccactccacttgaaattatgctcactccgcgcctctcttccaaactatatgtgtgttga

SEQ ID NO: 45 - DNA, 1665 bp, Eschscholzia californica
atgggtctttcatttgatctttcttctcataactttcttcaattctcgaaccccactattctcattggcctctttggtttactagtttaccttttactagtaaatcttcgaaaacgaatatcacgaaaaaatgaggcacccgaagtggagggtgggtggcctatcataggtcatcttcatcatttcatgggtgggaaaaacaagctactccatgtagcatttggagcttgggctgataagtatggaccagtctatactctgaggatgggtctgaataaagtactagttgtgaatagtgcagaagtagcaaaagagtgttcaaccactaatgacatgctttttatggctcgtccatatcgaatagcctctgagatcatgggttatggatatgcgatgtttcctatcgctccttatggaccattctatctcaaaatgcgaaaaatggtcacccaagagcttctctcaaatagtagggttgattctctaaaacatgtgtggggttctgagataaaaaatgccattcaagaacttcacaagaaagtattatcaactaaaggtggtggtccaatttcaatggacatgaagggatgggtttccaatttaacgttccgaacggctatgaaggtgatttgtggtggtgttggtgttgatggtggtggtggtggtggtggtgctacttctcctgcaactagtattggagaacataattatgatgaagttggaagttttcaaaaagcattgaaagaattctttgttttactaggagaaattaggatttctgatgtgataccattcctagggtggttagatatgcgaacagggtacgtggaaaagatgaaggacaatggaaaatttctagacaatttaatggaggaaatgttggaagaacacaaaaggaagagaaggtcactaactgaagaagaggaaaaagatggaggttatgtggagcaagatttcatggacgtaatgatatcgaaacttaatgatccaaagcttctgtcctattatgacgctgatactatcaacaagtctacttgcctgactctaattttaagtgggagtgagacaacgatggttagtatagtttgggccttagcgttactagtcagtcatccacacgtgttaaagaaagcgcaagatgagttggatacgcttgttggtcgggaaagacaggtagacgaatctgatatcaaagatttggtatacctccaagctgtagttaaggaagcattgagactatttccaccggctccactttcaactccacgcgttgcaacagaggattgtgtcgtatcaggatatcatgtacctgcagggacccaactttttgtaaatacttggaagattcaacgtaacccggaagtatggcctgaaccatcagagtttagacctgagagatttttcacaacccacaaggatttcgacgttagaggtctacattatgacctccaccctttcgggtctggtagaagagcatgtccaggtgctggcttcgcccttcaagtggtgcatctaaccctagcttctctattacatgggttcgagattaaaaacccatcggatgaacccattgatatgactgagagtccaggagtaactaacttgaaagcaaccccactgaaagtcctcctgacccctcgcctcttctctaaagaagtttattaa

SEQ ID NO: 46 - DNA, 1686 bp, Eschscholzia californica
atggagaagcccatcctcctccagctccaacctggtattttaggcttattagctttgatgtgcttcttatattatgtaataaaggtttcattatctacaaggaactgtaaccagttggtgaggcatccgccggaagctgcaggttcatggcctatagttggtcatcttcctcaactagtaggctctggtaagcctctgtttagagttctcggagacatggctgacaagtttggaccaattttcatggtgcgatttggagtacacccaaccttggttgtgagcagttgggagatggcaaaggaatgcttcacctccaacgacaagttcctggctagtcgcccacctagtgctgctagcatttacatggcatacgaccacgctatgcttggcttctcctcttatggcccatattggcgtgagattcgtaaaatatcaaccctccacctactctcccatcggcgccttgagttgcttaagcacgtccctcacttagagatccacaattttatcaagggattgtacggaatttggaaagatcatcaaaaacagcagcagcagcctactgcgagagatgatcaagattcggttatgctggagatgagccaattatttgggtacttgaccttgaacatcgtattgagcttagttgtaggaaagagggtttgcaactaccacgctgatggtcatcttgatgatggggaagaagctggccaaggtcaaaagctccatcagacgataactgatttctttaaactgtcaggggtttcagtggcttcggatgctcttccgttcttaggcttgtttgatttggatggacaaaaaaagatcatgaagcgggtagccaaggagatggactttgttgcagaaagatggcttcaagataagaaatcgagtttgttgctgtctagcaaaagcaacaacaaacagaatgaggcaggggaaggcgatgtggacgatttcatggacgtattaatgtccacactcccagatgatgacgattcctttttcacgaagtatagtcgagatactgttattaaagccaactccctctctatggtcgtagcaggctcagacacgacatctgtttctttgacatgggctctttccttattactcaacaacatacaagtcctaagaaaggctcaagatgagctggacacgaaagtcggtagggacaggcatgtagaagagaaagacatcgataacttggtctatcttcaagctatcgtcaaggaaacactccgcatgtaccctgccggtccactttcagtaccacacgaagccattgaagactgtaatgttggcggataccacataaaaacaggaacccgtctgctggtgaacatatggaagttgcagcgcgacccacgagtgtggtcaaatccatctgagttcaggccagagagatttcttgacaaccaaagtaatggaacactgctggatttcaggggtcaacattttgagtacataccatttgggtctgggcggaggatgtgcccaggcgtgaaccttgcaaccccgattcttcatatgacactagcacgcttactacaatcattcgacttgaccacaccctcgtcatccccagtagacatgactgaaggttcaggattgacaatgcccaaagtaactccacttaaagtactactcaccccacgcctccctcttccactttatgattattag

SEQ ID NO: 47 - DNA, 1698 bp, Eschscholzia californica
atgaatttgtctagcaaattgatgggttcatttgatcttttctctcttaactttctccagttctcaaaacccgccagtatggttattattggcatttgtagttttctagtttacttttcactactaaatcttgtaaggcgagtactagcaccgtcttgtacgatgaaaaacggaaaaactgagccaccggaggtggaaaacgggtggcctattataggtcatcttcaccatttcatgggtaaaaagaataagctaatccatgaaatatttggagacatggctgataagtatggaccgacctttactttaaggatgggtctgactaaagttctagtagtgagtagtgccgaagtagcgaaagagtgtttaactacaaacgatttggtattcattggtcgtccacctcgtgtagccaattcactccttggttatagttttgccatgtttcctttttcgccttatggcacatactatagccaaatgcgaaaaatagtcacccatgagcttctctcaactagtagggttgagtctctaaaacatgtgtggaattctgagataaacaaagccattcaagaacttcatcacaaagtagtatcagttggaggtggtagtcctgttttaatagaatttaagcgttggttttcggatttaacgttaagaactactgttaagttgatctgtgggaagcagtactttggtacggatggtgctactcaggcgagtatgactattaatggaggaggagatgatgatgaagctgggaagtttcaagaggccttgagagagttcttttgtttactaggaaaatttagggtttctgatgtgataccatttttagggtggttagattttggaacaggttataaggaaaagaaaaatagaatgttcattgatagtttaatggaggaatggttggaagaacacaaaatgaagagaagattactaaatgaagcagataaaaaagaaagtcgtatagagcaagatttcatggatgtaatgatctcgaaacttgatgatcctaaccttctatcccattacgatgctgatactatcaacaaggctacttgcttgactttgattttagggggaagtgacacaacaatggttagtttggtttgggccttaacattgttaatgaatcatccacatgtgttgaaaaaggtccaagatgagcttgatttccacgtaggtcgtgagagacaggtcgaagaatctgatatgaaaaacttagtatatctccacgctgtaatgaaagaggcaatgagactaaatccagcaggtacgttatcggctccacgtatgtcaacaaaggactgcaccgtatccgggtaccacattcctgcaggaacccatctattcatgaatacttggaagattcaacgcgaccctaatgcatgggttgaaccaacagagttcagaccagagagatttctcactacccataaggatttcgatcttagagggcagaactttgaactcctccctttcgggtcgggtagaagatcatgtcttggtgctaactttgctcttcaagtgttgcgccagactctagctcgcttgttacatggattcgatctcaaaactccatcagatgagcccgtcgatatgactgggtctgctggactaattaatatgaaagccactccactcgaagttctagtcaccccacgcctcttctctagtgaattatatgggtaa

SEQ ID NO: 48 - DNA, 1853 bp, Eschscholzia californica
atgctcataaaacctctcgggagcaagataacatctcctcctccctccagtgtcaaagaaaaaagagaaatccgaagggtcgtcatgaggtatataagtgggcttaaacgatgcaaaatcagcaagataaagccaattccaagatgtaaccaaaacattctcgcatttaatatcaccatgacaaacaccaagtatcttccaatgaatttgctcatcttcttccaattcctcctccaattccaagttcttgtaggattatcagttttgctagccttctcctattacctatgggtttcaaaaaatcccaaaatcaacaaatttaagggtaagggtgccttattagcaccccaagctgccggggcatggcctattgttggtcatctccctcaactagtaggccccaagccgctcttcagaattcttggagccatggctgacaactatggacctatcttcatgctccgattcggggttcatccaactgtcgtcgtgagcagttgggagatgacaaaggaatgtttcactaccaacgataggcaccttgctagtcgtccatctaatgctgcttcccagtaccttatctacgaagtctatgctttgttcggcttctccttatatggtagctcatattggcgtgatgctcgtaagattgctacgctcgaactactctcccatcgtaggcttgagttgctcaagcatgtaccttatacggagatagatacatgtatcaaacaattgcacagactttggacaaaaaataacaaaaaccaaaacaaccctgagcttaaagtcgaaatgaaccaattttttactgatctaaccatgaatgtgatattgaagttggttgtaggaaagcggtttttcaacgttgacgatgcagcggatcatgaaaaagaagaagctcgaaaaatccaggggacaatatttgagttttttaaacttacggagggttcagtttcagcaggtgctcttccattactaaattggctggatctaaatggacagaagagagccatgaagagaacagccaagaagatggactccatagctgaaaaattgcttgacgagcaccgacaaaaaaggctatcaaaggaaggtgtgaaaggcactcatgatcataatgacttcatggacgtattattgtccattcttgatgctgatcaaggagattattcccatcatccattcaactacagtcgcgaccatgtcataaaagccaccactctgtcaatgatcctctcttccatgagcatatctgttagtctttcatgggcactctctttattactcaacaaccgccatgtcttaaaaaaggcgcaagatgagttagacatgaacgttggcaaggacagacaagttgaagagggagacatcaagaacctggtctatctccaagccattgtcaaggaaacattccgtatgtatcctgcaaatccacttcttctaccccatgaagctattgaagactgcaaaattggtgggtttaacgtaccagcaggcacacgtgtggtagtcaacgcatggaaactacaacacgacccacgcgtgtggtcgaacccatccgagtttaagccagagaggtttctcaatgaccaagcagcaaaggtagtagatgtgagaggtcaaaattttgagtacttaccatttgggtctggacgaagagtgtgtccaggaatctccttctccctccaaaccattcacatgtcactagctcgcctagttcaggcattcgagctaggaacgccctcgaatgagcgcatcgatatgactgagggttccggcttaaccatgcccaaaacaaccccgcttcatgtccttcttaacccacgtcttcctcttccactctatgaatg

SEQ ID NO: 49 - DNA, 1599 bp, Eschscholzia californica
atggagtttcattttcctctcatggaacaattccaaccatttttcatttttgcccttcttctagcctccttcatttttctctacaaactcttcaattttggaaacagaatcactaaaaatgggaaaccaacagctccggaagcatcaggaggaagactaattatgggtcatcttcatctattcaatggaactgagttaactcaccggacactcggttctatggctgataaatacggtccagctttcaatatccgattcggttcacataaaacacttgtagtgagtagttggaaaattattaaagaatgttttactacaaatgaccgattcttttcgaatcggcctggttctttagcaatcaaactcatgttttatgatgccgattcagttgggtatgcaccatatggatcgtactggagagaacttagaaaaatttcaaccttaaaactcctttcgaaccatcgtttagaaaccctaaaacatttgagaacttctgaagttgattcttgttttaatcaactaatgaattcttgggctgaaaacaaaaacaggggagactctgattttgctccggtgaggatggatgattggtttggggatttgacgtttaatgttgtagcaagaattgttgccggaaagaagaatttcgccggaggagcagcgagaggtgatgccggagctcagagatataaatcagccatggatgaagcttttagactgatgacaatatttgcttattcagatgtgattccatctcttgggtggttagataaattgagaggactagttggagatatgaaaagatgtgggtctgaaattgattcagtagttgagagttgggtggatgaacatagattgaaaagaagggtttctaagaaaggaggtgaattagatcttgaacaggatttcattgatgtttgtttggatatcatggaacattcttctttgcctggtgatgatcctgaaattgtcatcaaatctacttgcttggacatgatattgggtggaagtgacacaacaacagtaaccctgacatgggccctatccttgcttttgaaccatccccaagtcctgaaaagagccaaggaagaattagatagtcaagttggaaaggaaagacaagtagaagactctgacattcccaaccttcctctcatccaagctatcatcaaagaaacaatgagactgtatccagccggcccattgatcgaacgacgaactatggaagattgcgaggttgctgggttccacgtaccggctggcacacgtctattagtgaatctatggaagatgcagagagacaaggaagtgtggagtgaagaacctttagagtttagaccagagagattcctaacgagcaacacagaagttgatctcaaaggacaacattatgaactgataccatttggagcaggaagaaggatatgccctggtgtgtcctttgcggtgcagttgatgcatttggtgctcgcacgtcttcttcatgggttcgaaatgacaacaccaatgggtgagaaggttgatatgacagagagtgcaggattaattagtcacaaaatcacaccacttgaagttcttatcaaaccactcagggtctaa

SEQ ID NO: 50 - DNA, 1533 bp, Eschscholzia californica
atggattccttcttgcttgcttattgggttccaatttcagttgcttctattattgcttttgttttcctctacaatctcttttcttcaagaactcttcaaaataagaagattaggacagcacccatggcaacgggtgcttggccgattctcggtcatctccatctctttggttctggtgaattgcctcataaaatgctagctgccatggctgacaagtatggctcagccttcaggatgaagtttggtaaacacacaacactagttgtgagtgatacccgtatcgttaaagaatgtttcactaccaacgataccctcttctctaaccgtccttccactaaagcttttcaactcatgacttacgataatgagtcggttgcctttacaccttacggtycttactggcgtgagattagaaagatatccactcttaaacttctatccaaccatcgtctccaagccatcaaggacgtaagagcctcggaggtaaacgtctgcttcaaaaccttatacgaccagtgtaagaatccaagtggatcagctcctattttgatcgatatgaagaaatggttcgaagaggtgtcgaacaacgtggtgatgagggtaattgtggggagacaaaactttgggtctaagattgtgcaaggtgaggaggaagctatccattacaagaaggtcatggatgagctcttacgtctcgctagcttgtctatgttctcggattttgctcctttacttggtttcgtggacatctttcaaggaaacttgagtgccatgaaacgaaacgccaagaaggtagatgcaatcctggagaactggttggaagagcatcgcaagaagaagaactcagttgctgaaagccagcaagatttcatggatgttatgttgtcgattgttgaggagagcaagttgtctggtcacgatgctgatgccgtaattaaagctacttgtctagccatgatcatgggcggaacagataccacagcagtgagtctaacatggatcatttctttattaatgaataatcgtcacgctttgaagaaagctcgagaagagttagatgcactagtaggaaaggacagacaagttgaagattcggatttgaagaatttagtttacatgaatgctattgttaaggaaacaatgagaatgtacccattaggtactcttctcgaacgtgagactaaggaggattgtgagatcgacgggtttcatgtcaaaggtgggactaggttgctagtgaatgtgtggaagttgcaacgagacccaaatgtatgggttgatccaacagaatttagacccgaaagatttctaacggagaatgcagatatagatgttggaggtcagcattttgagttgctaccatttggagcaggacgaagggtgtgccctggggtgtcgtttgcactacaacttcatgcatttagtacttgctcgcctcatccatggatacgatttgaatactctaaacgaagaaaatgtggatctgacggagagcccagaaggacatgtgaaccacaaagcatcgcctcttga

SEQ ID NO: 51 - DNA, 1605 bp, Glaucium flavum
atggagtttctctctctacaacttcaaccagtttccatttttgctcttcttgttgcctccattttcctctacaatttcttaattcacggaaaaaaatccaacaacaagaagaccacaaaaccaccagcaccagaagcatcaggtggatggccaattatgggtcatctccatctcttcaatgaaaacgagttaactcaccgaacactcggttccatggctgacaaatacggtccagctttcaacatccgattcggttctcatcctacactcgttgttagcagttgggacatcgttaaagaatgtttcacaacaaacgaccgattcttctcgaatcggcctggttcgttagcgattaaactcatgttctacgatgccgattcagtcggttatgctccctatggtgcttattggagagacttgagaaaaatttcaactctgaagcttctttcgaatcatcgattggaaaccctaaaacatttgagaacttctgaagttgaatcctgttttaaagaactttataatcagtggaggaacaacaaaactggtggtggtggagatggttttgctccggtgaggatggataattggtttggtgatttgacgtttaatgttgtggcgagaattgttgccggaaaaaagaattttgccggtggtgcggcgagtggtgatgccggagctcagagatataaggaagctatggatgaagcgtttaggttgatgacgatttttgcgttttctgatgtggttcccgcgttggggtggttggataaattgagaggtttagttggaggaatgaagcgttgtggggcggaaattgattctatagttgcggggtgggttgatgaacatcggttgaagagaagctctggcaagggaagtgatgctgatcttgaacaggattttattgatgtttgtttggagattatggaacattccacattgcctggtgatgatcctgaagttgtcatcaagtctacttgcctggacatgattttgggtgggagtgacaccacaacagtgaccctaacatgggccctttccttactattgaacaatccccatgtgttgaaaagggctagggaggaattggatacaaatgttggaaaggatagacaagtagacgactcagatatccctaatcttgtatacatccaagcgatcatcaaagagactatgagattatacccagctggaccactgatcgagcggaggacatcagaggattgtgaggtaggtgggttccatgtaccagctggtacacgcttattggtaaacttatggaagatgcaaagggacgggagtgtgtataaggaggatcctttggagtttagcccggagagattcctgactagcaacgcagatgtagatttaaagggacagaattatgaattgataccatttggggcaggtaggaggatatgtccaggtgtgtcatttgcagtccaattgatgcatttggtgctggctcgcctcattcatggcttcgaaatgaagacgcctgaaggtggaaaggttgacatgacagaaagtgcaggactaattagtcacaaggtgacgcctttggaagttctgctcaaaccacgtctagcaatccaacattcatag

SEQ ID NO: 52 - DNA, 1686 bp, Glaucium flavum
atgcatgcgaaactgaccttgattaagaaaatggagttcaccatcatcaactctctagaaatccaaccaataatctccactttcgctcttcttactttctccattcttctctacaaaattctcttgaaccatggaagagaaaacaagaacaataaaccaaaaacatcatcatcatcatcatcaataccagaagtagcaggtgcatggccgataatgggtcatctccatctcttcaacggagacgagttaatgcaccataaactcggttccatggccgaaaaatatggtcaagctttctatatccgatttggttctcataaagcggttgtggttagcaattgggagatggttaaaacatgtttcactacaaataaccaaatcttcttaaataggcctcccatgttagctattaacctcttgtttttccccaccgattcgcttagttacataccgtatggtgaccactggagagagttgagaaaattttcaaaccaaaaacttctttccaatcaccgcatcgaaacccagaaaaatttgagaaaattagaagttgattactgttttaaacagctttgtaatcagtcttctaagtattttataattaacaacatggacgaccaagacagcaagtttgctctagtgaggatggatacttggtttgatgatgtgacattgaatgttctggcaagaattattgccgggaaaaagaagtttatatccggcggagcaacgagtagtggtgatgatgataatgctgaagctcggagatacatggaagctttagatgaaggacttcgtctgatgacgagtttcactttctccgatgtgcttccgtggttggggtggttggataatttgagaggtttggctggaaagatgaagcgttgtggtgcagaacttgattcggtttttgcggggtgggttgaagaacatcgtgtgaagagaggctctagaaaggatggtgatgatgctgatcttgaacaggattttattgatctttgctgggagagtttggaacaggtgcctggaaatgatcctgcaaaaatcatcaagttaatttgcatggaaatgattttgaacgggagtggcgccacggcagtgaccctaacatggaccgtctctttactattgaacaaccccgacgtgttaaaaagggcaagggaggagttggatacacacgtcggaagtcatcgacaagtggacgaatcagacatccctaatcttgtttacatccaagcaatcatcaaagagggaatgagattgtatccacctggaccattccttgagcgaagtacaactgaagattttgagatagatggggttcatgtaccagctgggactcggttatgggtgaacttatggaagatgcaccgagacgagagcatgtatcaggaaccactcgagtttaaaccagagaggttcttgaatagcaattcagatgtagatctaaagggacagagttaccaattgctaccatttggggcaggtaggaggatatgtcctggcgtgtcgtttgcgttgccgttgatgcatctgacattggctcgtctcattcatggcttcgaaatgaagttgcccgtaggtgttgaaaaggttgacatgacagaaaatggaggtataattaaccggaaggcgacacatttggatgtgctgctcaaaccgcgcctcatcgctcaacaagcttaa

SEQ ID NO: 53 - DNA, 1611 bp, Glaucium flavum
atggatacactttcaattcaatggattgtaccttccatagccacccttcttgccttagttttcctctacaatctcatttttacttccaaaaaaactaccaagactaacaacactaggaaggcaccaatggcatccggcgcatggccggttcttggccacctccatttatttggaaccggtgagctacctcacaaaatgcttgcaacaatggctgaaaactacggtaccgccttcacaatgaagttcggtaaccacactacactagtcgttagcgacactcgcatcgtaaaagaatgtttcactaccaacgacacccttttcgcgaaccgtccgtccaccaaagcattcgatctcatgacttatgccaatgactccgtagccttcacaccttatagcccgtattggcgtgagcttcgaaagatatcgactcttaaacttctctcgaaccatcgtctccaatcgattaaagacgttcgcgtcgcggaggtgaacgtatgttttagaggcttacacgttctatgcaagagtaaaatctatggagctccggttttagttgacatgaaaaaatggtttgaagaggtctcgaacaatatagtcatgagagtgatcgtggggaaacaaaattttgggtctaggattgtgcaaggacaagaggaggctgtctattacaagagtgtcatggacgagcttttacgtctagctagtgtatccgttttatcggattttgcaccgttatttggttggttggatttctttcaaggaaacataagtgctatgaaacgaaatgggaagaaactagatgtgatacttgagagatggatggaggagcatagacaaaagaagataagctcatcgtcgtcgatagccgcgtccggcgccggtgaagatgatgagcaagactttatggatgttatgttgtctatcattgaggagactaagttgtccggtcgcgacgccgataccgttattaaagctacttgcttggccatgatcatgggagggactgacactacagcggtaagcctaacatggatagtctccttattgatgaacaatcgacatgtactgaaaaaggctcgagaagaattggactcactagttggaaaggatagacaagtagaagattcagatttgaagaattttgtatacatgaatgctattgtcaaggaaacgatgcgattgtatccgtttggtgctttgctcgaacgcgacaccaaggaggactgtgaggttggtgggttccatgtcgaagccggcacccgtttactagtaaacgtatggaagttacaacgagaccctaatgtatggaaagatccattagagtttcgaccagaaagatttctggtcgagaacgtcgatatcgacgtcggcggtcaacatttcgaactattgccgttcggggccggtagaagggtgtgccccggcgtgtcgttcgcacttcagttcatgcatttggtactagctcgtctcatacatggatatgaattggaaacactaaatggtgaagatgtggatttaactgagagcacagaaggacatgttaaccataaagcatcccctcttgatctcctcatcacccctcgcctcgactctaaggtctacaattactag

SEQ ID NO: 54 - DNA, 1599 bp, Glaucium flavum
atggatagtacccttgttctccaatgttttgtaggttccatggcagctgtttctgccttggttttcctatacaatctcatatttagctcatcgaaaactaccaagggtaaggttcttaggaaggcacctatggcagccggggcatggccaattcttggtcacctccatttgtttgggtcaggtgagctgcctcacaaaatgttatccaagatggctgagaagtatggccctgcgtttacattgaagttcggtaagcacacgacactagttgtgagtgacacccgcgtcgtaaaagagtgtttcactaccaatgatacacttttcgctaaccggccttcgactaccgcatttgatctcatgacttatgccaatgactctgtagccttcacaccttatagtccttattggcgtgagcttagaaagatatctactctcaagcttctctctaaccaccgtctccaatcgattaaggaaatccgtgtctcggaggtgaacgtatgttttagggagctatttgagatgagcaagagcaaaaccgatggagctgctccggctttggtggatatgaagaaatggttcgaagaggtgtcgaacaatatagtcatgagggtaatcgttggaagacaaaattttgggtctaagattgtgcaaggtgatgcggaggctgtcaactacaagaatgtcatggatgagctcctacgtctcgctagtttgtctatgttatcggatttcgctcctttacttggttgggtggatatgttccaaggaaacaagaacgcaatgaaacgaaatgccaagaaagttgacaccatactagaaggctggttggaggagcataggaagaagaacaagaagatgagctcatcagaaaatgatgaacaagacttcatggatgttatgctttcgattattgaagagaccaagttatctggccgtgacgctgataccgttattaaagctactgtcttggccatgataatgggtggaacagacaccacggcggttagtctaacatggattgtctccttattgatgaacaatcgtcatgtattgaagaaggctagagaggaaatagacgccattgttgggaaggatagacaagtagaagattcagatttgaagaactttgtatacatgaacgctatcgtcaaggaaacgatgcgattgtatccacttggtgctatgctcgaacgcgacaccaaggaggactgtgaggttggtgggttccaagtacaagccggcacacgattactagtaaacgtatggaagttacaacgagacccaaatgtttggagtgatccatcagagtttagaccagagagatttttatcggagaacgctgatatagacgtcggcggtcaacatttcgaattactaccatttggtgcaggtagaagggtgtgtcccagggtgtcgttcgcgctccaattcatgcatttggtactggctcgtcttatccatggatatgaattgggaactcaaaatgatgagcttgtggacttaactgagagcacagaaggtcatgttaaccatatggcttcccctctagatctcatcctcaccccacgcctcagcaaccctaagctctatgattattag

SEQ ID NO: 55 - DNA, 1557 bp, Glaucium flavum
atgttctttacttcatcttcaaaaaccacaaacaaaaacacaagtaagaaaccacccatggctcccggtgcatggccaatactaggtcatcttcatttgtttaaagaaggtgagttacctcaccacatgcttaaatccatggctgataaatacggccccgccttcctcatgaagttcggccaacaccggtccctcgtcgtcagcgactaccgcattgttaaagaatgtttcactaccaatgacaccttattttccaatagaccgtctacaactgcctttgctgtcatgacttacgctacggactccgtcgcgttcaccgaatatagtccttattggcgtgagcttcgaaagatatccactcttaagctactctcgaacaaccgtctccaggcgataaaaaaactccgagaaagcgaagtgaacgtctgtttccgaggtttatatgattcgtggaggaagaataagagtgaacagaatggtgctggtaatagtattgatggtggtaacgaacgagcacgtccggttctcgtcgacatgaaaaaatggttcgaagaggtgtcgaacaacttagtcatgagggtaattgttggtaaacgtaattttgggactaagattgttgaaggggagaaggaggctgttgagtataagaccattatggatgaactcttacgtcttgctagtttgtctttgttatccgattttgcacctatacttcgtttgtttgatcactttcaaggacatattcgtactatgaaacgaaatggcaagaaactagacgtactacttcaacggtggttggaggagcatcggagaaagatgagcacgccggaggaggagcaagatttcatggatgttatgttgtccattgttgatgagagcaagttgtctggtcacgacgctgatacggttattaaagctacttgcctggccatgataatgggtgggacggacacatcggcggtgagtctaacatggatagtctccttattgatgaacaatcgtcatgcactagcaaaggctagagaagaattggacaagcacgtaggtaaagatagacaagtagaagaatcagatttgaagaacttggtttacttgcatgcaatcgttaaagaaacaatgcgattatatccattgggacctcttctcgaacgcgaaacgaagcaggattgcgaggttggaggattcgatatcgccggaggcactcgtatactagtaaacatatggatggtacaaagagatccggccgtctggaacgacgcgacggagtttataccggagcggtttctaacggagaaatcggatgtagatgtttggggtggtagttttgagcttataccatttggagccggccggagggtgtgccccggcgtgtcgtttgctctacaattcttacatttagtattggctcgtcttatacatggatatgaattgaaaacgccaaatgatatgccggtcgacttaacggagagtactgaagggcatgttaaccataaagcatcacctttggatcttcttctcgtccctcgccttagcgacctgaagctctatgattactag

SEQ ID NO: 56 - DNA, 1614 bp, Glaucium flavum
atggattccattcttacaaccgttgttctcctttccatacttctctactttctattctcatggcagctaaacaaatactctgctactaagaagaataccaaatcatcaaaacagctaccaccagaaccggctggttcatggcccgtcattggtcatctccatcttctcgccaaaggatcaaacttgccccatataaatttgggagccatggctgacaagtatggaccaatcttcatgatccgtatcggcttaaatccaacactggtggttagtagttgggaggtagcaagagagatattcacaaccaacgaccaagttttctcctcccgtccaattcaagtatccacgaaacacttgggtttcgacactgctatgtacggtttcgcaccttatggaccatactggcgtgaaatcagcaaattagtgaagcgtgaagttctatccaacactagactagagttcctaaagcctgtttggggctctgagatcaacacatctatcaaagaattgtatgatgtgtgtgtaatgaaaaacaaagaagaaggtggtactggtccaattattgtggaaatgaagcaatggttctcagatttagcattaaacatgtcggttaagttggtagccggtaagagatattttggtgcttctcaactaggaaatgaggaagctgcgaggtggcaaaaggcactgagaaactgctttaggttggtggggctgtttgttgtgtcggacgcaataccatttctaaggtggttggacgtgggtggtcacgaaaaagaaatgaagaatactgctaaagagttggacgatttgttggagggatggctggaagaacataaaatgaaaaagaagttatcattaagtgaagttgaagctgagaagaaggaaagggatcgggttgacttcatggacgttatgctgtccacacttgaacatgaaaaggcatctgactatttcccggctgatactatcaacaaggctacttgcttggctctaatccttggtgggactgatactaccacagttgtttgggtttgggccttggctctactagtgaataacccgaatgtgttaaagaaggcccaagatgagttggatgtccatgtaggtaagaaaagacaagtggatgaatcagacatcaaaaaccttacatatctccaagccataatcaaggaatcaatgcgtctctacccagcagctacattaggtataagagaatcaacagaggattgcactgtagctggctaccacatccctgcagggactagtttgatagtgaattcttggaagattcaacatgacccacaagtatggactgacccatttgaatttcagccggagagatttctcacaggccacatggacgtcgatattagaggtcagagttgcaaattcctcccttttgggtcgggtagaaggtcatgtccagggacatcactcgctcttcaaatggtaaccttgacacttgctcgtttgatccatgggttcgagttcaggactccgtcagaagcacccactgatatgacagagagcgctggactaactaatgttaaggccaccccacttgaagttctagtctcaccgcgccttccttcggagctttatgtttgttaa

SEQ ID NO: 57 - DNA, 1614 bp, Glaucium flavum; identical to SEQ ID NO: 56

SEQ ID NO: 58 - DNA, 1716 bp, Glaucium flavum
atggatttacaaatcttcttccacttccaaggaattgtaggctcattagctttactatcattcttctattatctatggagacttttaactacgacgaagacgagtatttgtaacggtacaacggctgcaccacctgaagtttccggtggttggccgatactgggtcatcttttgcagctagtaggatcgaaacagccgttgttcaaggttcttggagacatggctgataaatatggacctatttttgttgtccggtttgggatgtacccaactcttgttgtgagcagttgggagatggcaaaggagtgcttcagtaccaacgatagagtcctagctactcgtccaactagtgctgctagcaagtaccttacttacaactatgccatgtttgctttcacattttatgggccttattggcgtgagattcgtaagatatcaactatagaattgttgtcccatcgacgtgttgagatgttcaagcatgttccgttcatggaaatcgatacgtgtatagaacaactatatcttctttggatgcagaaccagaaccagaaccagaaccaaccgaacggagatccggttcaggtaaacatgagtaaagtatttgaagaactaactatgaatgcggtgttgaagttagtcgtcggaaaacgccttaccgacgacaaagaaggcgaaaagctgcacaagaccattcaagaattctttaaactgttagaggtatcagttgcatcggatgtttttccattccttgggtggctagatgtggatggacaaaagagaaaaatgaaaagggtagctaaggagatggacataatagctgaaaaatggcttgaagagcaccgccaaaagagaagtagtaagttggaggaggaggaggaggaggaggaggacgacggcggcggcaaaggagacgcggcggcggcagataaggatttcatggacgtgttgttatccttattggaaggagatgaaggtgattctgatcaacccttcatgaactatagtcgcgatacagtcatcaaagccacctctctgaatatactcgtggctgctacagacactacatcacctaccttaacatgggctatctcattactactcaacaacccccatgtcttaagagaggcccaaaatgaactagacatgaaggtaggaagggatagacaagtcgaagagcaagacattgagaacctaatctacctccaagcaatcgtcaaagagacactccgattgtacccagctggtcctctctctatcccccatgaggctattcaagattgtaaacttggcggatatcatgtaagggcaggtacacggttgttgctgaacatatggaagctacatcgcgacccacgcgtgtggtcgaacccacttgaattcaagccagagaggtttttaattctatcggaggaggtgtgtggttgcagtcgtggaacacaaaattttgattttaaaggccaatgttttgagtacataccatttgggtcgggacgaaggatgtgcccaggatacaactttggcatacaaatcattcacatgacactagcacgcctacttcagtcattcgagatgcagcctgcaaaagctaaatcgctaaatgatcaagatgggcctgtcgacatgagagaaggttctggcctaacacttccaaagataaccccattaaaagttctccttacaccacgcctctatggtcagctttataatcattag

SEQ ID NO: 59 - DNA, 3210 bp, Hydrastis canadensis
atggacttctccatgctcttccaatggctattggttactatggctacccttcttttcttgaattctgtttacaatgtttggtataaatcttcaaaaaacactagtattactactacgactagtaaaggaaagaaggcaccagtagctgctggtgcacggccgttcatgggtcaccttcatatgttagtagggggcaagcaattgcctcaccaggcacttggaaagttggccgatatatacgggccagctttcatcattcatattggcccaaacccagaacttgttgtaagtagttgggagcttgcaaaggagtgtttcactactaatgacaagtatttcgctaaccgtcctactaacaaagccatgaagtacttgacatacgacgaagcatccgttggctttggaccttatgggccactctgggttgaaatgcgaaaaatagctaaatctaatcttctctctcaacaaaggctccaaatgcataaacgtgtccgagtcttagaaatagacgcgttttttaaagaactccatgagctatggtcgatgaagaaagaggatggtccagtttctgtagacatgaagcaatggtttgaagaattgacacttaatgttatcaccagaatggtttctggtaaacataaatatgcaactaaggcaagacggggtgatagtgaggcgaagcaattcaaaagagtaataggtgaggcagcacattttacaggaaatcttttgctatcagatatatttccatctcttgggttcttggataacatgcaaggtcgtgtgaattccatgaagcgaacaggcaaggaacttgactccatccttagttcatgggttgaagagcatcgccaaaagaaactatcaggagagcagtcagaggatgaagagaaagactttatcgatcttacgttgtccatgatggacgaaattcagctccactcgactgactcagagaccttcatcaaagctatttgcgtgggtgtgatcctaggtgggagcgacacaacatcagtgggaataacatggatcctttctctactaatgaatcatcgcgatgttttgaagaaggcccaagaagaattggatcaacaagttggaatggacagaaaagtagaggattcagatctgaataatttggtatatctcagggcaatcgtaaaggaatcaatgcgtttgtaccaagttgggccacttattgaacgaaaggcatcacaagattgcaccataggcgggttccatgtcaaagcaggaactcgccttttggtgaacctttccaaggtacacaaagacccaactgtgtggtcagatcctttggaatttcaaccggagagatttcttacgacgcactcaaacatggaccttaagggacagcatttcgaactacttccttttgggtcaggtagacgaatgtgtccagggtacttgtttgccctcaatgaaatgtatttggtgcttgctcgtctcattcaaggctttgaactgggaactcctatggatgcaaaggttgatatgacagaaacatcaagtgttaccaactacagagcaacaccccttcaagtattgctcaccccacgcctcagtcctaagctatacgattattaaatggacttctccatgctcttccaatggctattggttactatggctacccttcttttcttgaattctgtttacaatgtttggtataaatcttcaaaaaacactagtattactactacgactagtaaaggaaagaaggcaccagtagctgctggtgcacggccgttcatgggtcaccttcatatgttagtagggggcaagcaattgcctcaccaggcacttggaaagttggccgatatatacgggccagctttcatcattcatattggcccaaacccagaacttgttgtaagtagttgggagcttgcaaaggagtgtttcactactaatgacaagtatttcgctaaccgtcctactaacaaagccatgaagtacttgacatacgacgaagcatccgttggctttggaccttatgggccactctgggttgaaatgcgaaaaatagctaaatctaatcttctctctcaacaaaggctccaaatgcataaacgtgtccgagtcttagaaatagacgcgttttttaaagaactccatgagctatggtcgatgaagaaagaggatggtccagtttctgtagacatgaagcaatggtttgaagaattgacacttaatgttatcaccagaatggtttctggtaaacataaatatgcaactaaggcaagacggggtgatagtgaggcgaagcaattcaaaagagtaataggtgaggcagcacattttacaggaaatcttttgctatcagatatatttccatctcttgggttcttggataacatgcaaggtcgtgtgaattccatgaagcgaacaggcaaggaacttgactccatccttagttcatgggttgaagagcatcgccaaaagaaactatcaggagagcagtcagaggatgaagagaaagactttatcgatcttacgttgtccatgatggacgaaattcagctccactcgactgactcagagaccttcatcaaagctatttgcgtgggtgtgatcctaggtgggagcgacacaacatcagtgggaataacatggatcctttctctactaatgaatcatcgcgatgttttgaagaaggcccaagaagaattggatcaacaagttggaatggacagaaaagtagaggattcagatctgaataatttggtatatctcagggcaatcgtaaaggaatcaatgcgtttgtaccaagttgggccacttattgaacgaaaggcatcacaagattgcaccataggcgggttccatgtcaaagcaggaactcgccttttggtgaacctttccaaggtacacaaagacccaactgtgtggtcagatcctttggaatttcaaccggagagatttcttacgacgcactcaaacatggaccttaagggacagcatttcgaactacttccttttgggtcaggtagacgaatgtgtccagggtacttgtttgccctcaatgaaatgtatttggtgcttgctcgtctcattcaaggctttgaactgggaactcctatggatgcaaaggttgatatgacagaaacatcaagtgttaccaactacagagcaacaccccttcaagtattgctcaccccacgcctcagtcctaagctatacgattattaa

SEQ ID NO: 60 - DNA, 1587 bp, Hydrastis canadensis
atggcctttgttgctcttattgttgtttacaatatctggtttaaatctgcagcaagcagaaataagaccagctataataacaaaacaatgagcaagacaccagtagttgatggtgcgaagcccatcattggtcacctccatttgttaatgggaggtgacctgcctcatcatgcgctcggaagattagccgataagtatgggccaatcttccttatgcacattggcgcattcccagaactcgttgtgagtagctcggaactcgcaaaagagtgtttcactaccaatgataaatatattatcaaccgtcctaccaataaggccatgacgtatttgagttacgaacaagcatctgttggttttgcaccttatgggccactttggattgagatgagaaagatctctaaatccaatcttctctctaaccaaaggattcacatgcagaagcaagtacgagtggcagaactggacgcgttctttaaagaactgtaccagctgtgtcgttcaaacgatgaaaacaacaacaacagtactagtcatggtaaagttttggtggagatgaataaatggtttgaagaactgacactcaatgtagtgactagaatgatatgtggtaaacaaaaaatgggtactaaggcaaggcttggggatagcgatgcgaagcattacaaaaaaaccattgatgaggcagcacattttatgggaaaccttgtgatctcagacgtagttccatgtctaggaatgttggacaatttactaggtcatgtgagcgccatgaagcgcacaggcaaggaacttgacacaatctttggttcatgggttgaagaacatcaacaaaagatcagactctctggttataaagatgatgctgaagaggaggagcatgactttattgatcttacattgtccatgatgaagggatcaactgacctccatggtcttgaccctgcaactttcatcaaatctatatgtgtgggtatgatccttggcggcacggacacgacatcggtggccttaacatggatcctctctctactactaaataatcgccatattttgaagaaggcccaagaagaattggaccatcaagtaggaaaagagagaaaggttgaagattcagatctcaacaatctggtctttataggagccattgtgaaagaatcaatgcgtttatacccagttgggcctcttattgaacgtgaggcaatagaagattgtcagattggtggtgtccatgttaaagccggcacgcgattactaataaacatttggaaggttcaacaagatcctaaaatttggcctaatccttcagagtttcgaccagaaaggtttctggattctaacatggatgttaagggccagcatttcgaactcattccttttgggtccggtaggcgaatgtgtccaggaatgtcgttcgccattaatgaattgaatttggtgcttgctcgtcttcttcaaggcttcgagttggaaactccaatgaatgcaaaggtagacatgactgaaacttcaagcgttacgaattataagggaacccctctccaagtacttctcaccccacgtctcagttctaagttatatatgtaa

SEQ ID NO: 61 - DNA, 1596 bp, Hydrastis canadensis
atggagtattcccatcttctcccatggctagcaacttcaatagctgccatttttgctttcatttttctcttttatgtccggaggaggaaaaacaacaaagcctttattcataatcatgccaaaaaagcacctgtggtaccgggtgctttgccgtttcttggtcacctccgcctatttactggaccgattttacctcacaaagcgcttggagcacttgcggataagtacggtccggctttcactatctatctgggaagtcatcaaacacttgtggtcagtggtcgagagttggtaaaagaatgcttcactactaatgatagattgttctctaatagacccagaagtaaggctgtcaagtacttgacttatgatgaagcctcagttggttttgcaccttatggcccactttgggttgagatgcgaaaggtttcaaaactcaattttctttctaatcaacggatccagatgcagaaacaggcactagcctcagaattgaatttttgcttcaaggatgtgtatcaattgtggttgaaaaataaggaactccccgttatggttgatatgaccaaatggtttgaagaaatgacgttaaatgtgataacaagattgatttgtgggaaacaaaactatggatctaaggctaacagtggtgaaagtgaggccaaaaggtataaacaagttgtagaaaaggcagcacatcttacatcaactgttgtgatgtcagatgtgtttccttttcttgaatggtttgataagtttcaaggacaggagaaagtcatgaaaaaagtagctaatgaatttgattcaatccttggttcatgggtcgacgaacatcgtcgaaagagacttcttcgaggcaacaatgaggaggaggaggaagagcaggacttcattgatctttccttggccatgatggaggaaactcagcttcatggtgttgatcctgataccttcatcaagtcaatgtgtttgggcatgatccttggaggaggtgacactacgccggtggccctaacatgggccctttcgctactattgaataacccagatattatgaagaaagcccaagaagaaatagaccaagtcataggaaaagagagaaaattagacgggtcggatataagtaatctggtctacctccaagccgttgtgaaagaatcaatgcggttataccaagttgggccattgattgaacgcgaaacaactgaggattgtaagattggtgacttccatgttgaagcaggcacgcgtttactagtaaacatttggaaagtacaacaagatccatgtgtgtggtcgaaccctacggagtttcaaccggagagatttctttctagtaagtcagatatggatcttaagggtcagcattttgaactaattccttttgggtcaggtagacgaatgtgtccagcagttgcttcagctctccaaatgatgcatttggtgcttgcaaaactcattcatggctttgaattaggaactcccatgaatgcaaaaatcgacatgacagaaacttcaagtataaccaacaacatggcaactcatcttcaagtgctactcaacccacgtttaaatgctaatctttatgatttttag

SEQ ID NO: 62 - DNA, 1632 bp, Hydrastis canadensis
atggcggatttcaccatgctcctccaatggttattgcttaccatggctacccttcttttcttgaatgctgtttacaaaagtattaaatcttcaaaaaacactattaatgataccagttttaaaaaaggaaagaaggcaccagtagctgctggtgcaagaccctttattggtcacctccatatgttagtaggaggcaaacaactacctcatcaagctctcgggaagttggccgataagtatgggcctgccttcatcatcaatattggtccaaacccagagcttgtcgtaagtagttgggagcttgcaaaggagtgtttcactataaacgatcggtgtttcactgatcgtcccagtaacaaagccatgaagtacttgacctacgacgaagcctctgttgggtttgcaccttatggccctctctgggttgaaatgcgcaagattgctaaatccaattgcgcatttcaacaaaggctccaagtacagaaacgtgtacgtgtcttagaaattgacttattttttaaagagctccacgagctatggtcccacgctggtgctggtgctaccggtactagtgtaattcctctttccatagacatgaagaaatggttcgaggaattgacactaaacgtgatcaccaggatggtgtctggaaaacataattatgcaactaaggcaagaaagggtgatactgaggcgaagcgattcaaaagagtgataagtgaggcagcacattttacaggaagacttctgctctcagatatatttccatcacttgggttcttggataacatgcaaggtcgtgtgaactccatgaagcgaacaggcaaggaacttgattcggtccttagttcctgggtggaagaacatcgccaaaagagagtctctggaaataaagagcagtcacctgaggatgatgatgtggaacaagattttatcgatctcacgttgtccatgatggaggaaattcagcttcactggactgacgctgacaccttcatcaaagctatctgcgtgggtgtgatccttggggggagcgacacgacatccgtgggcataacatggattctttctctgctaatgaatcatcccgatgttttgaaaaaggccagagaagaattggaccaacaggtaggactggaaagaaaagtggacgattcagatctcaataatctggcctatctcagagccattgtaaaggaatcaatgcgtttgtaccaagttggcccactgattgaacgtaaggcaaaacaagattgcaacataggtgggttccatctcaaagcaggcacacgcctacttgtgaacctttccaaggtgcacaaagacccgactgtgtggtctgatcctaatgagtttcgccccgagagatttttcaccacccacaccaacatagatatcaaggggcagaattttgaactcattccttttgggtctggcagacgtatgtgcccagggtacttatttgctcttagtgaaatatatttggtgcttgctcgtctcattcatggcttcgaattgagaactcccaatgatgccaagcttgatatgacagaaacttccagtgttaccaattacagggcaacacctctccaagtactactcactccgcgcctcagttctaagctctactga

SEQ ID NO: 63 - DNA, 1599 bp, Hydrastis canadensis
atggactacttttccatgccttaccaatggttactaacttccttagctactcttattgtctttgtttttatctggtctattactgctggaaaaacaagtactacttctaacaaagcgaaaaaggcaccgccaatagcggctggtgcatggcccattatcggtcacctccatttgataatggggggtgaactccctcatcgattgctttcgaatttagccgataaatatggcccaatcttcatgctcaactatggttcacaacctggattagttgtgagtagcttgaagcttgctaaggaatgttttgttcataatgatagagctgtttttaaacgtcctaatagcaaagccatgaagtatttcacttatgatcaagcttcatttggttttgcaccttatggaccactttgggttgaaatgagaaaagtgtctaaatcaaatcttctttctaaccaaaggcttcaattacaaaggaatcaacgtgcctcagaagttgatgcttttataaaagagctttaccaactatgtaagaagtccaacaatggtactcttatggtagaaatgaataaatggtttgaagaattgacacttaacgttgtgactagaatggtttgtgggaaaaaaaacattggggctaaagcaaggcatggtggtgataatgaggcaaaatattataagaaagttatagatgaagcaacaatatttacagctaaattggtggcttcagatttttttccttctcttggatgggtagattatttgcatggtgatgagagtgctataaagcagacagccaaagaacttgattccatcattggttcctgggtggaagagcatcgtcaaaagagactactctcgctcaataaagacgactacgcagagcaggattttatcgatattacgttgtccatgatcgaccaaactcagcaccagggtattgatgctgataccttcgtcaagtctatgtgtgtgggtatgatctttggtgggagtgacagcacatcggtggccctaaattgggctctttcaatactaatgaataatcgacatgttttaaagagggcccgagaagaaatcgacacacttgtagggaaggacagaaaagtgaacgatgtggatgttactaaattggtttatctcaaagccattgtaaaagaatcaatgcgtttatgcctagttggaccgcttcttgaacgtgtgaccgtagaagattgcgagataggtggtttttatgtcaaagcaggctcgcgcatagtggtaaacatatggaagttgcaacatgacccagacctgtggtctgatgatgttatggaatttcgaccagagagatttctcacaaccaactcaaatgtggaacttaggggtcaacattttgaactcattccttttgggtctggtagtcgaatgtgcccaggtgtaacattcgcactcgaactcatgcacttgacacttgctcgtctcattcatggatttgaacttggtacccctatggatgcaaaggttgacatgacagaaacttcaagtgttaccaattacaaggccacaccccttgaaatccttctcaccccacgccttcatcctaagctttatgatttttag

SEQ ID NO: 64 - DNA, 1605 bp, Hydrastis canadensis
atgtttatatcgatcactcaacaatccatggattcatttcaccaatatctagcaactataatttttggtgtcttttcctttgtattattcttgatctattatctaccattgaagagaagtagaagtgataaaaagagagctgctcccaaaccggtcggggcatggcctatcataggtcacttgcctatgttatcccggcaccaaccaccgcacataacgttgggaaatattgctgataagtacggaccagctttcactcttcagcttggcgtgcatcgagcattggtggtgagtagttcagaggttgccaaggagtgtttcactaccaatgacaaggccttagcttcccgcccaagctctgtggctttaaagctaatgggttataacaatgctatgtttggcttcggcccttatggttcatattggcgacaaatgcgcaaaatagttgtacttgagcttctctcaaaccatcggctccaattgctaaaacacgttcgtatatctgaggttagcacatctttaaaagaattgtaccaggtttgggcatcatgtactaataagaacgacaaaggacaagttttggtggatatgcagcaatggtttggtgacttgacactaaacgtctccgttaggatgattgctgggaagcgatactttggtgccagtgcagcatgcgacgaagatgaagcgaggaggtttcagaaggcgattaaagatttcctccatttagtaggcttgtttgtggtgtcagacgcgcttccctttctagaatggctagatattcagggtcatcagaaagccatgaagagaactttcaaagaattagatagaatacttgggaaatgggtggaagaacatcgacgaaataaattagacggtggaacgaatgtgggacgagacttcatggatgtgatgtcttcgatacttgacgatgcaaatatctctgattatgatgctgataccattaacaaggctacttgcctgagtctgatcttgggtgggactgacaccacaatggtcactctaacatgggctttatccttattaatgaacaatcaacacatattgaagaaggcccaagatgaaattgacatctatgttgggaaagataaaaacgttgatgaatcagatatagagaaactggtgtacctccaagccattgttaaggaaacattgcgtttgtacccagccggtccactatctgggccacatgaggccatagaggactgcactgtagctggttatcatgtaccaagaggcacacgcttgataacaaatctctggaagattcaacgagatccacggatatggtcgagcccttgtgagttccaaccagagagatttctcaccactcaagcaaatgtggatgttaggggccagcattttgagtttcttccattcgggtctggaagacgttcgtgccctgcgacctcatttgcacttcaagttgtgcacttagcattagcacgtgtattacaaggcttcgagtttgaaactcaatcaaatgcacctgtggatatgaccgagagcgcgggacttacaaatgtcaaagccaccccgcttgaagttctaatcaccccgcgcctccctttgaatctatattaa

SEQ ID NO: 65 - DNA, 1590 bp, Hydrastis canadensis
atggagtcgcttcaccaatatctagcagcagtcatgagttgtatctttgccttgttactcttcctctattatttcccatggaagatcagaagaagtagctctgataataacatgagaagtgcacctgaagcagctggtgcatggcctatcataggtcacttgcccatgctgggagggcaccaactaccccacataacgttgggaaacttggccgataggtacggaccagccttcactatccggcttggtgtatgccgggcactggtggtaagtagttcagaggtcgcaaaggagtgtttcactaccaatgacaaggcctttgccacccgcccaagctctgtggccgtaaagctaatgggctataactatgcactctttggcttagccccttatacttcttattggcgtgaagtgcgcaaaatagtaatactggagcttctctccaatcgtcggctagagttgctaaaacatgttcggatctctgaggtcaacacatctataaaagaattgttccaagtttgggcatcatcaaataataagaatgagaaaggacaagttttggtagagatgcagcgatggtttggtgacttgacaataaacgtagctgttaggatggttgctgggaaacgatacttcggtgctagtgttaatacgtgcgatgatgaggaggaggcgaggaggtttcaaaaggcgattaaaaatttctttcatcttgtagggttgtatgtgttatcggattctcttccatttttggagtggttggactttgagggtcatcaaaaggctatgaaaagaactttcaaagatgtggactgtatacttcaaagatggttggaagaacatcgacgagataaagagaatggtgcaatgaaggaggagcgagacttcatggatgtgatgttgtcgatccttaaagatgcaaatctctttggttacgaagctgatactgttaacaaggccactagtctgaatataatattgggtgcaacagacactacaatggttactctaacatgggccctatcgttattattgaacaatcgacacatattaaagaaggctgaagatgaaattgacatccatgttgggaaagataaagctgttgatgaatcagatatagagaaactagtatatctccaagccattgttaaggaaacattacgtctgtacccagttgctccactgttagcagcacatgaagccatagaagactgcattgtagctggttatcatgtaccaagaggcacacgcttgataccaaatatttggaagattcaacgagatccacgcatatggtctagtccttgtgatttccaaccagagagattcctcacaacccaagcaaatgtggacgttaggggtcagcatttcgagttgtttccttttgggtctgggagaagaatgtgcccagggatctcatttgggcttcaagtagtgcacttggcactagcgcgtgtattacaaggcttcgagtttgatactccatcaaataaagctatagatatgactgaaagcgcaggacttaccaacctcaaggccacccctcttcaagttctaatcaccccgtgcctccctttgaatctgtattaa

SEQ ID NO: 66 - DNA, 1593 bp, Hydrastis canadensis
atggattcaattttactaccaactccattaatggtcagtctctttgccttactattatgtctttactatttaatcatatcgaggccaaggtctagtcataatactagtactaaggaggcacccgaagccgctggagcattgcctattatcgggcacctccatttgttaggtgggcgaatattgcctcacataacattaggagccatggctgataaacatggaccagccttcatgattcgcattggtgtacatagagcattggtggtaagttcttcagaagttgcaaaggagtgtttcacaaccaatgacaaggctttcgcttctcgtcctaagcatacagcagcggaactcatgggttataattatgccatgtttggatttgcaccttacggtcctttttggagcgaaatgcgcaagataatcatggctgaactcctctccaatcgtcggcttgagttgcttaaatacatccgggatttcgaattaaaagcatctatcaaagaactatacatgacatgggagaaccacagtgttactaataaaggtcaggtagtagtagaaatgaagaaatggtttggagacttaactctaaatgtgattctaaggatgattgctgggaaaagatactttggttcaaattctacttgtgatgaaagtgaagcaaagatatgtcaaaagggtatgagagatttctttaggttattgggagagttccttgttgaggatgcaattccttatttggggtggttggacttgcaaggttttaaaaaagagatgaagaatacagctaaagaacttgatattcttcttcaaggatggttggaagagcacaaaaaaaagagggagttctctaaggatgttaaggaagagcaagacttcatggacgtgatgatgaccatacttgaagatgcaaacttctctgattttgatgctgatactatcaataaggctacgtgtttgactataatctcaggaggaagcgacactacaatgcttactctaacatgggccctatccttactactgaacaatcaacatgtgttgaagaaggcccaagatgagttggacacccacgtcggtagggatagacgcgtggacgaatcagacatcaagaacctcgtctaccttaacgccatagtgaaggaaacattgcgcttatacccagctagtccactactgggtattcgggtgtccacagaagactgcactgtagctgggtaccatgtcccatcagggacccgtttaatggtaaatgcttggaagattcaacgagacccgttagtgtggtccgacccatttgaatttcgcccagaaagatttctcacaacccatgtaaatgtggatgttaagggtcaaaattttaatttaatcccatttgcatcaggtagacgtgtgtgcccaggagttgcatttgcccttcaaatgctgccactagttctagctcatttgctacatgggttcaaactcatgactcagttgggtggacctgtcgatatgactgaatccactgggttaactaatatcaaagcaactccattggaagtagttatcagcccacgtcttcgtccagaactgtatgaaatgtacacatag

SEQ ID NO: 67 - DNA, 1578 bp, Hydrastis canadensis
atggagtcgcttcaccaatatctagcaacaattttgagttgtatctttgcctttttactcttcctctattatttcccatggaagggaagaagaagctttgataataacttaagaactgcacctgaagcagctggcgcatggcctatcataggccacttgcctatgttaaaccaacgtgatttaccccacgtaacgttgggaaacttggcggataggtacgggccagccttcactatccggcttggtgtacgccgagcactggtggtgagtagttcagaggtcgcaaaggagtgtttcactaccaatgacaaggcctttgccacccgcccaagctctgtggctgtaaagctaatggcctataactatgcagtctttggctttggcccttatggttcttattggcgtgaaatgcgcaaaatagtaatacttgagcttctctctaatcgtcggctagagttgctaaaacatgttcggatctctgaggtcaacacatctataaaagaattgtaccaagtttgggcatcaaataataagaatgagaaaggacaagttttggtggagatgcaacgatggtttggtgacttgacaatgaacgtagttgttaggatggttgctgggaaacgatacttcggtgctagtgttacgtgcgatgaggaggaagcgagaaggtttcaaaaggcgattagagattttagtcatcttgctggtttgtatgtgttgtcggatgctcttccaaatatagagtggttggactttgagggtcatcacaaggccatgaaaaaaactttcaaagatttggactgtatacttcagagatggttggaagaacatcgacgagatagagagaatggtgcaacgaagggagagcgagacttcatggatgtgatgttgtcgattcttaaagatgcaaatccttttgatttcgaggctgataccgttaacaaggctactagcctgaatatggttttgggcggaacagagactacaactgttactctaacatgggccctatcgttactattaaacaaccaacacatattgaagaaggcgcaagatgaaattaacatccgtgttgggaaagacaaacctgttgatgaatcagatatagagaaattggtgtacctccaagccattgtcaaggaaacattgcggttgtaccctgtccttccattatccgtaccccacgaggccatagaagactgcaccattgctggttatcatgtaccaagaggcacacgcttgataacaaatctatggaagattcaacgagatccacacatatggtctagtccttgtgagttccaaccagagagattcctcacaacccaagcaaatgtggacgttaggggtcagcatttcgagttgtttccttttgggtctgggagaagaatgtgcccagggatctcatttgggcttcaagtagtgcacttggcactagcgcgtgtattacaaggcttcgagtttgaaactccatcaaatgtacctatggatatgactgaaagcgcaggacttacgaatttcaaaacaacccctcttgaagttctaatcaccccatgcctccctttggaccaatattaa

SEQ ID NO: 68 - DNA, 1578 bp, Hydrastis canadensis
atggattctcttctccagttacaaataattggagcacttgctgccttaatattcacttacaaactattgaaagtgatatgtagaagtcccatgactgatggcatggaagccccggaacctccgggagcttggccgattatcggacacctccatctgctcggtggccaagacccaatagcccgtacacttggagtcatgactgataaatatgggccaattttaaaactccggcttggtgtacatactgggcttgttgttagtaattgggaactggcaaaggagtgtttcactacaaatgacagagttttagcttcacgtcctatgggtgcagcaggaaagtacttgggctataattatgcgatatttgggctcgcgccgcatggaccatattggagtgaagtacgtaagatagtattacgtgaacttctctctaatcagagtttagagaagcttaaacatgttcgaatctccgagattaatacatgcttaaagaatttattttcattgaacaatgggaatactccaataaaagttgacatgaagcaatggtttgaacgcccaatgttcaatgtggtcactatgatgattgcagggaaacgatattttagtatggagaatgacaatgaggcaatgaatttcaggaaagttgccactgaatttatgtacttaactggggtgtttgtagtgtcggatgcccttccatatctggagtggttggatttgcaaggacatgtgagcgccatgaaacgcacggccaaggaattggacatccatgttgggaagtggcttgaggagcatcgtcgtgctaagcttctgggtgaaactaaaaatgaagatgattttgttgatgtgctgctaaccatcttgccagaggacttgaaggataatcaaacgtatatacatgaccgcgataccatcatcaaggcaactgcactggctctttttttagctgcctcagatactacagctatcaccttgacatgggctctatcgttgatactcaacaatccggacgtcttgaaaagagcacaagatgagttggacaaacacgtcggtaaagaaaaactcgtcaaagaatcagacatcataaatctagtgtacctccaagctatcatcaaggaaaccttacgcctgtatccagctgcacccctcttattgccacatgaagccatggaagattgtacggtaggtggctatcatgttccaaaagggactcgaatttttgttaacatatggaagttgcagcgtgatccgcgtgtatggtttgatcctaacgagtttcgaccagaacgattcttaaccactcatgcaaatgttgattttaagggacagcattttgagtacatacctttcagctctggtagaagggtatgcccagggatcacatttagtacccaaatcatgcacttaacacttgcccatctacttcatgaattcaacatagtgacccctacgaaatcaaatgcaggggttgacatgactgagagcttaggcatcacaatgcctaaagcaactccactagaagtacttctcactccacgtcttccatctaatctgtacaatcaatacagagactaa

SEQ ID NO: 69 - DNA, 1566 bp, Jeffersonia diphylla
atggattcacttcaactcatagctagtgttgtgtgtggattgtttgccttccttcgtatctactacttactaaagaagttgtctagtaacaaggaggcaccccaactcggtggagcatggccgattatcggccacttacatctattaggccgagttgagctcccccacatattttttagtgccatggcagacaagtacggtccagccttcatgattcagcttggtatgcgacgagcactagtagtgagcagtgcggagattgccaaagaatgtttaactacaaatgataaggccttagccactcgtccaagttcaatagcagctgagattatgggttatgactatgctatgttcgggttaggtccatacggggactattggcgtgaagtgcgcaaaatagtggtcttggagtttctctctaatcgtcggcttgagttgctaaaacatgttagggtgtctgaaatatccctgtctctgaaagagttgtaccaatcctgggaaaaacaaaacaaagctgatgaaccagttttagttcatctggaccaatggtttggcgatatgacgctcaatctttcagttagaatggttgctgggaaaaggtactttggtgcaactgctgcttgtggtgaagatgagtctaggaaagttcaaaaggcaacaagggaattcgataggcttttgggtctgtttgtagtgtcggattatcttccttttctgcggtggctggacttggaaggtcaccagaagttgatgaagagcataggtagagaacttgattctattctgcagggatggttggatgagcataaaactaggaggaactctggtggaggagctaagggagatcaggatttcatagacgtaatgctttccgtccttgaagatggaaacctttccaattacgatgctgataagctcaacaaggctacatcacttacgatgattgtagctggaagcgaaactacaatggtcactctaacgtgggctgtctgcttgttgctaaacaatccggaagtgttaaacaaagctcaagatgagttggacatgcacattggcaaggacagacaagtggaagaatcagacatcaagaacctggcatacctccaagctgttatcaaagaaacgatgcgtttgtacccagttgctccactattaattccccatgaagccatggaagactgcaccatagctgggtatcatgttcgagcaggcacacgagttatactaaatggttggaagcttcaacgagacccatttatttggtctgacccttgtgagttccaacctgaaagatttctcaacaacgatgtggatgtgagaggtcggcattttgagttattgccatttgggtcaggtagacgtgcatgccctgggatttcattggcccttaatgtggtgtctttgacattggctcgtttgttacatgagttcaagttttcgaatccttcagaaggcaaggttgatatgtctgagagtgcaggggtggttgttgccaaggcaacacctctggaagtacttatcattccacgcctaccttcaaagttttacgagtactataagctatag

SEQ ID NO: 70 - DNA, 1557 bp, Jeffersonia diphylla
atgttttctcttcagttgctatcaactccattgtttggcttctttaccctgctggccatttactatctcttatggactaagagtaacaaaaccaaggaagcacctcaacctgctggagcatggccaataatcggccacctccatctactagccaggagtgaactcccccatataactttgggagccatggccgataagtacggtccagctttcatgatccgccttggtacacgccaagcaattgtagtgagtaattcagagattgcaaaggagtgcttgaccatcaaagataggatcttcgctactcgtccaagcttagtagcatttaagctcatgggctacaactctgccatggtcgggttaagcccttatggaccttattggcgggagttgcgtaagataatcgcgttaaaagtcctctcacaacgtaggctggagtctctaaaggatgtgtgggactcagaaatatcctcatccttaaaccacttgcaccaaatatggtcacaccaaaccgaacccaatggaaagattttagttgaaatggatcaatggtttggtgatctaacactaaatgtggcagttaagatggttgcagggaagagattctttagtgctgatgctgcttgtgatgaaaatgagtctagaaggtgtcaaaaggcaataagagagttctttaggcttttgggtcaatttgtagtatcagattctcttccatttctagggtggttggacttggaaggttatcagaaagagatgaagagtacagccaaggaagttgattcaatacttcagaaatggttggatgaacataaacagaaaagacaatctgcaggagctgatagagatcaggatttcatggacgtgatgctttctctcctagaagatgcaagcctctcccaatatgacactgataccatcaacaaggctacctgcttttcaatgatcgtaggtggaagtgatactacgaagatcacactgacatgggctctcaccttactactaaataatccagatgtaatgaaaaagagccaagacgagttggatatccaggttggaaaagataggcatgtcgaagaatcagatatcaagaatctagtatacctggaagctatagtgaaggaaactttgcgtttgtatccagctgctccactattagctccccacgaggccacagaagattgtattgtagctgggtataatgttcgcgcaggcacacgcttaatagtgaacgcttggaagattcaacgagaccccttgatttggccgaacccttctgagtttctaccagagagatatcttaacaaagatgtcgacgttaaaggacaacattttgaattaatcccatttgggtcaggtagacgtgcttgccctggaatcacatttggacttcaagtggtatccttgaccttggctcgtctcctccatgagtttgagatttccattgcatcaggaattaaagtggatatgacggagagcggaggtctagttactgccaaggccacccctttgaaagcacttatcgccccacgctttctttattctcatcatcacatttag

SEQ ID NO: 71 - DNA, 1578 bp, Mahonia aquifolium
atgaattcacttcagttcctagcaactccattgcttactctcattgcattactatgtgtttactgcatagtatggagaaaatcattctctagaaacggaagcaaaataaagcaggcgccctgggcaggtggagcatggccgatcatgggtcacctgcatctactagcctggggtgacctcccgcatataacgttgggagccttggccgataagtacggcccagtcttcatgatgcagcttggcatgcgccaagcaatagttgtaagcagtgcagagattgcaagagagtgtttcaccactaatgataggatcttagcaactcgcccaagctctatagcagttaagctcatggcctacaactacgccatgtttgcatttgccccgtatgggcctaattggcgtgaaatacgcaagacagtcatgcttgagctcctctccacccctcgcctcgagtcactcaagcatgtctgggaggatgaaatatccacgagtgtcaaagagttgtatgaattatgtgccagcaaaaccaaaacccatggccatgtttcagtagacatgaagcaacggtttggtgatctgacactcaatgtgttagtgaagttggttaatgggaagagatactttggtgcaaatactgattatactgaacatgaatcaaggaggtgccagaaggcagtgagggattttttcagtcttatggggttgtttgtggtatcagattttcttccatttcttgagcggttggacttgcagggttatgagaaagagatgaaaagggtagctagagaagttgatggtatagttcaagggtggttggacgagcataaaaggaagcgagagtccagtgaaaccacccacgatcaggacttcatggacgtgatgctttcgatacttaaagactcaaaattctctaactctgattatgatgccgataccatcaacaaggctacatgttttaacatgatcttaggtggaagtgacacaacaatgagcacaatgacctgggctttatcggcactgctaaataatccacatatgttgaagaaggcccaagatgagttggaattccatgtcggaaagggtagacaggtggaggaatcggacatcaagaagctaacatacctacaagctataatcaaagaaactttgcgtttatacccgtcggctcccctgttagctccacgtgaagccacagaagactgcaaaatagcggggtatcatgttccagcaggcacacgcctaatcgtgaatgtctggaagattcatagagacccatttgtttggcccaaccctaacgagttccaacctgaaagattcctaaataaagatgtggatgttaagggtcagcatttcgaattgatcccatttgggtcagggagacgtgcttgccctggggtatcattaggacttcaagtggtgtcactgggcttggcgcgcctcctacacggatttgagctttcgatcccatctggaagcaaggtagacatgactgaaactgcaagtctagttactttcaaggcaacgcctctggaagtatttatcactccacgcctatctccacatatgtatgtggagtag

SEQ ID NO: 72 - DNA, 1511 bp, Mahonia aquifolium
cttatgcatggaagaggaaaaaccatacaaaggatagcaaaatcaaagagccaccccaaccagccggagcatggccgataatcggccaccttcatctaatatcccgcggcggcctcccccatataaacatgggggccatggcggacaagtacggtccagttttcatgatccggctaggagtaaatcgagccgtgattgtgagtaactcggagatcgtaaaagagtgcttcacaacaaacgataaattcctactaaaccgtccagttgggttggccttaaacctcatgagttacaacaacgccatgttcgggttctctcggtacggtccatattggcgtgagatacacaaaatagtcatgcttgagctcctctcgagcagccggctcgagtccctgaagcacgtatgggactcggaaatattgacatccatcgaagagttgtaccaattatgtcaaacacaaaacaaggctcatgaaggcccagttttggttgaaatgaaggattggtttgcagatatggcactcaatgtgtcctttagaatggttgctgggaaaagatactttggtgcaagtgctggtggtaataaagatgaggcaagaaggtgtcaaaagaccatgagagatttctttagacttgttggcttgtttatagtgtctgatgcacttccatttcttaggtggctagacttgggagggcatcagaaggagatgaagagaacatttgaagatcttgactatgtgcttcaaggatggttggatgagcataaattgaatagaaaatctggtgggaatggtgatcaagatttcatggatgtgatgttatctactctttatgattcaaaatttaccgattacgacgttgacaccatcaacaaggctacgtgctttcaattgatcctaggaggaactgatactacaacggtcactctaacatgggccctttccttgatgttaaaccacccacatgtattgaaaaaggcccaagatgagttggacatccaagtaggcaaacacagacaagtggaggaatcagacatcaagaacctaaaataccttgaagctgtgatcaaagaaaccttacggatgcgcccagtaggcccacttttaggcccacgagaggcgatcgaggactgcaccattggtggatatcgagttcgagcaggcacacgcgtaatggtcaatgcttggaaggtgcaacgtgacccatcggtttggccaaaccctgatgacttcaaaccggagaggtttctcaagaaggatattgacttcagggaccaaaactttgaattcatccctttcgggtccggtagaagggcctgccctggaatatcatttgccgtggaactaytgcccatggctttggcccgtttactacatgggtttgagcttaagactcaattgggttgcaaggtggatatgacagagcatgccggtttagttcatgctaaggctacccctttggaagttcttgtcagcccacgcctgtctcgagagttgtatgtatcgtcttag

SEQ ID NO: 73 - DNA, 1590 bp, Menispermum canadense
atggattcaactgatcatcacctggcccttgtaatacccactcttctagctacccctgtcttattgttctccttctactgtctcctcttgagaccaaggagtctcaaaaaacctcgtactaacaaaccacctgaaccttctggttcatggcccatcatcggccatctccatctcttaagccaaggcctacctcacataacactgggagccatggccgacaagctcggaccagccttctcaatccgcctcggcacgcgccgagcactagtggtcagcagctgggaggttgctaaggagtgttacaccaccaacgaccgagccttcgcgagccgtcccagcagcatagcagtcaagctcatgagctacaacaactccatattggggttcgctccgtacggacagtactggcgcgagctgcggaagatagtggtgctccagcttctctcgaaccggaggctcgagtcgctgaagaacgtttgggaatctgagattgatttgtctataaaggagttgtacgatacatgggcaagtaatagaggaggagaagcgttaatggtggacatgaagcagtggtttggagaccttacgatgaacatagtggtgaggttggtggtggagaagcgttgttttgggagaagcgtgggtgacgatgagactgaggcgaggaggggccagagagcgctgaaagagtttttaaaactggtgggtttgtttttggtggaagacgcgtttccatttttgagttggttggatgttcaggggcatcagagagagatgaagagaatagcgagagaactggactcgctgtttcaggggtggttggaggaacataagaggaagagaagcataaaaggtgaggccaaaggagatcaggacttcatggacgtgatgttgtctgtactcgaggattctaccatcagcactgatatagaagatgacacagttatcaagtccacatgcttgactgttgtcttgggagggagcgacagcacagtgggaactctcacttgggccctctccctactcctaaacaacagacacgaattgaaaaaggcccaagatgaattggacgcctatgtgggtaaggaaagacaagtggacgaatcagacatcaagaacctcgtgtacctacaggccatagtcaaagaggttctgcgactctacccagcgggcccactatcaggcccacgagagtccgttgaggacactgtggtagcaggttaccatgttcccaaaggcacacagctcatagtgaacctctggaagattcaacgtgagccgtccatctgggccgaccctctagagtttcaaccagagagatttctcacgacccacaaaggcatggacgtgtggggccagcacttcgaattaatcccttttgggtccgggagacggtcgtgcccgggcacagcgttcgcccttcaagtgattcacctcacattggctcgtttgctacatgggttcgagctcaccacaccatgtggtgcacctgtggatatgagtgagagcgctggtctcattaatgtcaagaccacgccagttgaggttcacgtcgctccacgcctccctctcaagctatataaatcataa

SEQ ID NO: 74 - DNA, 1590 bp, Menispermum canadense
atgattttaattgcaatgggcaaccacattgaactgcaagatatcatactgtattcccttggattttttgctgctactattttatggagaatttttagtacctatgtccttagaaggaacagttgctccagaccaccagaagcagccggaaaattgccgttaattggtcaccttcatcttctaggagcgaacaagatattacatcatacacttggagacatggccgatcgacacgggccaatcttttctttgaatttgggaattaaaagaactcttgtgatcactagttgggaagtagcaaaagaatgttttacaacacaggacagggttttcgccactcgtccgaaatctttagttggaaaagtagtaggatataatagcacagttatgatatttcagcagtatggaccatactggcgcgagatacgcaagctagcaatgattgagcttctgtcaaatcgtcgactggaaatgctcaaacatgttcgggaatcagaggttaatcttttcatcaaggagctatatgagcaatggtcaagcaatgagaatggaagcaaggttgtggtggaaatgaaggaaaggtttggagatctgacaacaaatattgtggtcaggacagtggcaggtaaaaaatattctggtactggtgtgcatggtaatgaagagtcgaggcgatttcagaaggcaatgacagattttatgcacttagcggggctgtttatggtttctgatgcacttcccttgctcggttggattgatacattcaaaggatacaggggaaaaatgaacaagacagcagaagagattgatcatgtacttggaagctggttgaaggagcatcagcagaaaagaaaaaatatcagcattaatcatttagacgaagactttatccatgtcatgctctctgccatggacgggaaccagtttcctgacatcgacaccgaaactgccatcaagggcacttgtttaagtcttatcttaggtggttatgatacaacatccgccacacttacgtgggcactctccctaatcgtcaacaaccatcatgtgttgaagaaagcacaagatgaaatggacaagtacgtaggaagagatcgccaagtaaaggaatcagatgtgaagaatttaacttatttgcaagccattgtcaaggaaacactgcgattatatccagcagcaccactatcagtccaacacgaagcaatggaagattgcacggtggcaggatgtaacattccagctggcacgcggttagttgtgaacctctggaagatgcatcgtgacccgaaagtttggtctgaccctctagagtttcaaccagacaggttcctgcaaaaacatgttaatgtggacatttggggtcagaattttgagcttttaccatttggatcaggacggaggtcatgccctggtatcacatttgcgatccaggtcctgcacttgacacttgctcaattgcttcatgcgtttcaactgggaactgtctttgcctcgcccattgatatgactgaaagttcgggtgttactaacccaaaagcaactccactgcaagtaactcttaccccacgactgcctcctgaagtctactaa

SEQ ID NO: 75 - DNA, 1542 bp, Menispermum canadense
atggattcaacctaccaacttctctctgccctattgttcatcctctgcctttactatctcgtctgtaaaccaatcaccaaaacaaaaaacgacgaagctcctgtaccagccggagcatggcccatcatgggccacctccacatgctccgcggcccaaacctccctcacataaccctttcatccatggccgacaaacacggcccggccttcacaatccgactcggtacgcgccgagccctcgtagtcagcaactctgatctcgcgaaggagtgcttcacagtaaacgacaaggccttctcaacccgcccgagcaccgtagccacgaagctcatgggctacaacaacaccatgttcgggttcgccccgtacgggccgtactggcgcgagttgcggaagatagtgatgaccgagcttctgtcgagccgaagactcgagtcgctcgcgagcgtttgggcctctgagattgagtcctcggttaaagagttgttcgcggaatgggctgaaaacagggcgaagggtccagtggtggtggagatgggagagtggtttggaaacttgacgctcaacatagcgcttcgaatggtggtggggaagaggtatttgagagaagagtcgcggaaatgcttgaaagcgatgagggattatccggagctgtttgggaggtttttggtggaagacgcggttccgtttcttgggtggttggacttgattcaggggtatcagagagaaatgaagaaaacagcgagagaactggactctgttcttgaaaaatggctagtggaacataaagataagagaggttctggggaggggaaaggagagcatcaggacttcatggacgtgatgatatcggtacttgaagattcaaagctcagttacggagaggctgatacggtcaataagtcaacttgcctgaatctaatcttaggtgcaactgacacaacaatggtggctctcacatgggccctctcacttctactcaacaataaacaagtcctcaaaagagcccaacaagaactaaaatcccaaatcggcaataacaaacaagtgtcccaatccgacatcaagaacctactttatctccaagccacagtaaaagaagcactgcgactttacccaccagagccgctatctggcccgcgagaggccctcgaagactgtaccgtcgccggctaccgtgtccgagccggcacacggctgatagtgaacctgtggaagattcatcgagacccgtcgatatggcaggtccctctcgagttccggccggagaggtttctcacggcccacaaagatgttgatgtgtggggccagcacttcgagctgatgccgttcgggtcgggcagaaggtcgtgcccgggcatctcgtttgttcttcaagtggttccgttgatattggctcgtttgctacacgggttcgaactcacaacgcctggcgaggctttagtggacatgagcgagagcgcaggtcttgtgaacgccaaagtgacaccccttgaagttgttatttctccacgcctcccgctcgagctctttgcgggttaa

SEQ ID NO: 76 - DNA, 1605 bp, Menispermum canadense
atgattatgatgttcatcgactactactcctcatggcttccccaaactctactacttcaatcaattttactagctgtttccctagtcatcttcatcaatctctttctcacgaggaggaggagctactcctccaaatcccacaccaatatcatacaccctcccaaggccgccggagccctgccggtaataggccacctctacaccctctttcgaggcctctccgccggcgttcctctctaccggcaactggatgccatggccgaccgttacggccccgcgttcatcatccaccttggcgtctaccctaccctcgtagtcacgtgccgagaactcgccaaggaatgtttcactacaaacgaccaaacctttgccacgcgccccagcacgtgcgccggcaagtacatcggctacaactacgcgttcttcggcttcgcgccctacggcccgtactggcgcgaagctcgcaagatcgccaccgtcgagctgctctccaactaccgcctcgactcgctgcgccacgtgcgagaagctgaggtggggcgcaacgtggacgagctctacgccctccacgcgtcgtcatcaacgaataagcaaaacatgatgaagattgatatgaagcagtggttcgatcaggtgacgctgaacgtgattttgatgatggtggtggggaagcggtgcgtgaccactggtgggaatgaagaggaggtgagagtggtgaaggtgttgcacgagtttttcaagcacctagggactttgtcggtatcggacgtggtgccgtacgtggagtggatggatctggacgggaatatagggaggatgaagagcacagccaaggaattagattgtatattagggagatggttggaagagcaccgccgtgagaggaggagtgatttcatggacgctatgttggcgatggtggaggggattaagataccttattatgacagcgacaccgttattaaagccatttgcctgaatctcctcaacgctggatccgatacccttggcatcacgatgacctgggcactgtcattactccttaacaaccgccacgtgttgaagaaagtcaaagatgagctggacgtccacgtgggcaaaaaccgacaagtggaagagttagacgtcaagaacttggtgtacctccacgctgtcgtcaaggaaacgctgcgcctcttccctcccgcgccacttggcgtgccacacgaggccatggaagactgtgtcgtgggaggcttccacgtggcaaaaggtacacgtctcgtcgtgaacgtgtggaagctgcatagagatcctagcgtctggtccgaccctctggcgttcaagcccgagaggttcttggacaacaacacggttgacgttagaggtcagcacttccagttattgccattcgggtcgggcaggcggggctgcccgggaatcacgttcgcgcttcaggtggcgcacctgacgctcgctcgattgctgcatggattcgagtgggacacaccggatggtgcgccggtggacatgagcgaggtctcggtattgaccacggcaaaaaagaaccctgttgaggttttgttcactcctcgtcttccggcagaggtctacacgcaaaattag

SEQ ID NO: 77 - DNA, 1572 bp, Menispermum canadense
taccaattattattccttcaaaccgccattgcaggcctactgttcgccttagcactactagtgcgccttcgcttctcgaggcgtaacaatggcaagaagaagcaagcaccaccagaaccagccggagcacggctcatcatgggccacatccacatgctcaacagtggcgagcagcctcacaagaccctcgctgcactggccgaccaatacggcccagtcatcaagctccgcctcggcctacgcgacgccatagtagtaagcaattgggagatggccaaggagtgtttcaccactaatgacaaaatcttccttagccgtccccagaccgtcgtgtcaaagttcatgagctacaacctcaaaatgctcggcttcgctccttacggcccgtactggcgtgagattcgcaagatagtggtgtctgagctgctctcgaaccgccggctcgagctgctgaagaacgcgtggacctctgagatcagctcgtgggtgaaagagttgtttgacgagtggggtgcgaaggaggcgagagggcctgttgtggtggacatgaggcattggttcgggaacttggcgttcaatatagggatgaatatggtggctgggaagaggttttttgggccgagagtggtgtctgacgaggacgggttgcggcgagtccagcaaggcctcacggatttctttaggctaataggcgcgttcttgttggaggatgcggtgccgtttctaagctggtgggacagtcaggggtatcagaaggagatgaaggacactgcgagagagatggatacactgattcaaggattgttggacgagcataaacgtaggagatcatcaagctctggtgaggccaaaggggagaaggacttcatggacgttatgcttaatattcttgaaggttcaaagttccccagtggagacgctgataatatcaacaagtctacttgcttgtctctaatgctcggcttgacggacacaacaacggcgaccctcacatgggctctctccttgctacttaacgacccgcgtgtcttaaagaaggctcgagaagagctggatttccacgtcggaaagaacagactggtggacacatcggacttaatgaacctcccatacatccacgccatagtcaaagaagtgttgcgtctccacccaccggcgcctctctccggccaccgtgaatccttggaggacagtgtggtgggcggctaccatgtccccaagggcacccgctttatggtgaacgtctggaagatccaccatgacccgaataagtggcccgaccctattgagttccgacccgagaggtttctgaccacccacaaagatgtggaagtgtggggccagaactttgaactgattccgttcagttcaggaagacgagtgtgtcccggggcttcgttgtctctacaagtgcttccgttcacactggctcgagtgttgcaagggttcgaagttgcaacaccaggaggtgcgccggtggatgtcacggagagcaaaggcctctcaactgctaaagagactccgcttgacgtcgtgatcactccgcgtctccctgaaaagttctaccattga

SEQ ID NO: 78 - DNA, 1587 bp, Nandina domestica
atggattcactcatttcatttcaagcaatagttgggcttttcatcttgatcctagtttcctatcaatggcttggaaggtctagaagtattaagactaacaagcataacgaagcaccggaaccagccggcagatggcccatcatcggtcatctacatttactcggagggtcggaccaattactctatcgaacgctagggtccatggccgataaacttgggccggcattcaatatccggcttggtagccgtcgggcctttgtcgttaacagttgggaggtggccaaggagtgtttcaccatcaatgacaaggcccttgctagtagacccatcactgtggctgcaaagctcatgggctataactatgcagtctttgggtttgcaccatacagcccattttggcgagcaatgcgaaaaatagccacacttgagcttctttctaatcgtaggctcgagatgctcaaacatgttcggatctcggaggtggacatgggcttgaaagaaatttatgggctttggtccaagaacaaggattcaggccctttaatgattgaactaaacaggtggtttgagaacttgactctaaatatggttgtgagaatggtggctggcaagagatattttggtgctgatgcatcatgtgatgagaacgaagcgcagcgctgccagaaggcaatcagtgaattcttccgtctcattgggatatttgtagtatccgacgcgattccttctctatggtggttggatttgcaggggcatgagaaggccatgaaaagaactgccaaggacctggattctatactaggaggctggttggagcagcatcggtcgcggagagtcaatggtaaggtcccaaccgagggggaacaagacttcatcgatgtgatgttatcgctacaagagggcgatcatctctctgattttgagtatgatgctgatattgccatcaaatcaacttgcctggcacttatcctaggtggcagtgacaccactgcaggtaccctaacttgggctatctcattgctactaaaccatccctatgctttgaaaaaagcccaagaggaattggacctccatgttggcaaggacagacaagtctatgatcaagacatcaagaatctggtatatcttcaagccatcatcaaagaaacactgcgcctatacccagctggtccactattgggcccaagggaggccatggaagactgcaccatatcagggttcgatgttcgagctgggacgcgcttggtggtaaatgtttggaagattcaacgagacccaaacgtgtggtcgaacccatctgagttttcacctgaacggtttttgacaagccatgtggatgtcgatgttaggggacaaaatttcgagctcatgccatttggatcaggccgacggtcttgtccaggcgcttcatttgccctccaggtcctgcatttgacattagcccgttttcttcatgggtttgggttggcaaacccattgggaaaacctgtagacatgaatgagagcccaggactaactatcccaaaagcaacacccctaaatgtgctgctcactccacgtcttgattcagagctatatggttgctag

SEQ ID NO: 79 - DNA, 1563 bp, Nandina domestica
atggaaacctttcagttccttggaattccattgtttggcttctttgccttattatgcacttactacctagtattgaggaagccatcatccactaagatcagggagccacctcggccagccggagcatggccaatcatcggccatctccatttacttgcccggggtgacctcccccacgtaactttggggaagatggctgataaatatggcccagtcttcaagttaaagcttggtgtccgacaagcaattgtggtaagtgattgggaggtcgcaaaggagtgttacaccaccaatgatcgtgccttagccaatcgtccaagtggcctaggagcaaaaatcatgggctacaactatgctttgattgggtctgccccctatggcccatattggcgtgatttacgcaaaattatcacgcttgaagttctctcgagccgtcggcttgaatcactcaagcatgtatgggactctgaaatatccacatctgtaaaagaattgtaccaaatatgggcagatcaaaacaaagctcaaggccaagtttctgttgaaatgaaacaatggtttagtgatatgacactaaatgtggcagttaggttggctgtcggaaagaagtacttaggtgcaactgccgattgtgaaaagaataaggcagtgcaatgtcaaaaggccatcaggaattttttcagactcgctggtttgtttgtggtggcagattaccttccatttctgggctggttggacttgggagggcacgaaaaagagatgaagcacacagcaaaagaactcgattatatagctcaagaatggttggatgatcataaaaagaagagaacctccaatcggacagtggacgagccacaggatttcatggatgtgatgctctcgatcttggaagaatcgactttcacgggttatgatgttgatatcatcaacaagtccacatgttttgcattgatcctaggtggaacagacactgtggcagttactctgacatgggctctctgtttattactgaacaatccacatgtactgaaaaaggcccaagatgagttggacatccacgtcggcaaggatcgacacgtcaatgaatcagatatcaagaacctcgtttacctccaagctatgatcaaggaaacattgcgcttatatccagctggtccgctactaggtccccgtcaggtcattgaggactgcaccatagctgggtaccacgtacgagcagggacacgtgtgatagtcaatgcttggaagtttcaacgagacccgtcgatctggtcaaacccttgtgagttccaaccggagagatttctggacaaagacatcgatgtgaagggtcaacacttcgaattgatccccttcggagcaggcagaagggcatgccccggaatctcctttgctcttcaagtattaccattggcattggctcgtttactacatggttttgagcttaaaaacccatcggaaagccaagtggatatgactgagacccccggtatggttcatgccaagacaacccctttggaagtacttatcacaccgcgcttgtctccaaaattttatgtataa

SEQ ID NO: 80 - DNA, 1488 bp, Nandina domestica
tggaagaggccaacctctgttaagtacagggaggcaccccaaccagctggcgcatggcctatcatcggtcatctccatttactggcccgtggagacctacaccacataactcttggagccatggccgacaagtacggcccagctttcatgatgcggcttggtgtgcaccaagcaatggtggtgagcgattcggagtctgcgaaggagtgttccaccaccaacgatagggtcttggccactcgaccaagtagcgtagctgtaaaacttatgggctacaactatgccatgtttgggttcggcccctatggatcatattggcgtgaaatacgtaaaatagttattcttgaggtcctgtcaaaccatcggcttgagtcactaaaacatgtatggaagtctgaaatatccatgtccaccaaagagttgtaccaattatggataaaccaaaacaaggatgaaggcccgactttggttgaattgaagcaatggctttgtaacatgacactaaatataggagttaggactgttgctgggaaaagatactttggcgcaagttcttgtgatgcaaatgaatcaaacaggattcaaagggcaatcagagatttctttagatttgtaggtttgtttgttgtgtcagattttcttccttttctagggtggttggacttggaaggttatcagaaggagatgaagagtattgctagggaacttgattctatccttcagggatggttggatgaacacacaaggaaaagacaatctggtgggaccaacgaaaatcaggattttatggacataatgctttcagttcttgaacattcgaatgcattgactcactatgatgcagatacaatcaacaaagcgacatgctttacaatgatcttaggtggaagtgatactacaatggtcactctaacatgggccctctccttgttactgaacaatccacatgtcttgaaaaaggcccaagatgaaatagatatccaagtaggcaaggacagacttgtggacgaatcagatatcaagaacctagtatacctccaagctatagtcaaggaaactttgcgtctgtacccagctgttccaataataactccacatgaggccatagaagactgcaccatagctgggtatcatgttccagcaggcacacgcctcattgtgaacgcttggaagatacaaagagacccattgatttgggataaccctggtgagttccaaccagagagatttctctacaaagatgtggatgtgaaaggtaaacatttcgaattaatccctttcgggtccggtagaagggtgtgccctgggatctcgttggccctccaagtggtgtcattggccatggcccatctcctacatgagttcgaccttgcgaaaccatcagaaggcaatgtggacatgactgagagtgttggtttggttaatgctaaggcaacccctttggaagtacttatcactccgcgcctatccccaaagttttatgaatag

SEQ ID NO: 81 - DNA, 1578 bp, Nigella sativa
atgggttccttcaaccaaataaatccatctgttgtatactttgctgcctttaccatcttcttcttcttctttctctataaaatattatacaagagaagaaccagtgcgaagaccagagttgctcctgaacctgctggtgcgtggcctttcataggtcacttacccttgctatcccagcaaaacttgccccatgtaacattgggggtgttggctgacaaatacggaccagctttcactgtccaactcggcttacacaaagctgttgtggtgagtagttgggaggttgcaaaggagtgcttcactgtcaatgacaaagtgctcgctactcgccctagctcagttgcagtgaagattatgtgctataactatgctgtgtttggctttggaccatatggttcctattggcgtgaagctcgcaagatagttgtacgggagcttctctcaaaccatcggcttaatttgctaaaacatgttctggtcactgaaattagcatgtctatgaatgaattgtacacagtttggcaaaagaatgctaataatgttagtggaaaagctttggtggagatgaagcaatggtttggtgacttgtcattgaacatgattgtcaagatagttgctggaaagcgatacttccaagctagtgcaaattcagatgaaagggatcagttgaaaaggggagtgcaagatctcttccatttggttgggctgtttctggtgtcagatgcacttccatttcttagctggttagacattggtgggcatgagaaagccatgaggagaactgccaaggagcttgacaacatactggggagttggttggatgaacataaacaggctaaattggcaggggcgacaaagggagagcaagactttatggatgtgttgatgtccatactagaggataacaataatctccctgagtatgaaccagatgttgtcagtaaagctatttgcttgggtatgattttgggtggagctgataccacaacaattactctgacgtggattgtgtccttactactcaacaatcaacacattttgaagaaagcccaagatgaaattgacagcaaagttggaaaagatagacaagtaaatgaatcagacatagaaaaactggtatacctccaagcaattgtgaaggagacattgcgtctgtacccacctgctcctctgtcaacacaacatgaagccatggaggactgcaccatagctgggtatcatgtccaagctggtacaagattgataacaaatatatggaagattcaaagagatccaggggtatggccgaatccttgcgagttccagccagagaggtttctcactacccatgccaatgtggagtcaaatggaaagcattttgagtttattccatttggatctggtcgacgggcgtgcccaggtatgtcacttgggcttcaggtggtgcacctgacattagcacgtctgctacaaggttttgaattggaaactccgttgagtgtggaagtagacatgactgaaagtgctggacttacaaatctcaaagtaacgccccttgaagttttaatcaatccgcgtctaccttcaaatctatactag

SEQ ID NO: 82 - DNA, 1554 bp, Nigella sativa
atggatttgacaagcatcttgatttgtatctttcttttcatcatttctatctgctttctgtcatggaagcgatcaaggagtctttccggaaccagagcagctccggaaccagttggtgcatggcctgtcataggccatctaaggctgctaatggggtccaaaacacctcatatgaccttaggaaacttggctgacaactatgggccggcattcaccatccggcttggtacgaagaaaacactggttgtaagtagctgggaggtggccaaggagtgtctcactaccaacgacaaagccttcgctggccgccacagcactatggcggtggagataatggggtacaactatgccttcttcagcttaggtcctagtggtcaatattggcgtgaaattcgcaaaataacagtttctgaacttctttcaaatcgtcggttggagttacttaaacacatatggagctcagagattaagacttctatcaaagaattgtatgaaatttgtgcagcacaaagtcaatatgggaaaaaacagtctcctatggtagaaatgcagcaatggtttagtcatttgaacttgaatttatcagcaagaatggttgttggaaaacgatattttgctgacggtgttgaagaaaatgaaggcgatatcagacgatttcaaaatgcaatcaaggagttcttttactgggctggagcgtttataatagctgatacaattccatatctaaggtggatggatttcttaaatgagcggtcaatgaaaagaacagcaaaagaaacagaccatgtacttgaaggatggttgcaggaacacaaacgaaacaggctgaacggtgtaacgaaggagcaagatttcatggatgtgctgctgacagaacttggtgacaaagatctgtgtggttacacagctgatgttgtgaacaaggccacttgcctgaacatgatttttggaggaacagataccacaaaaacgggcatgatatggactttatcattaattctcaacaatccacaagtactaaagaagttacaaaatgaaattgacatccaagttgggaaagacagacaggttgatgattctgacatagggaatctcgtgtacctacaagccactgtcaaggaagcgatgcgcctgtatccacctgctaccatatttggacgtgaatccatcgaggactgcactgtggctgggtaccacatccaagctgggacacgtttgattgtgaatgcatggaaaattcaaagagatccaaatgtatggcccaatcctgacgaatttcagcctgagagatttctgacaaaccaagcagatgtggacttcaggggtcaagattttgagctcattccttttggggctgggagaagggcgtgtcctggtatttcattgacagttcgggttacacatttgacactggcatgtttgctacaaggcttcaactttgaaacccccttgaatgaacctgtagatatgtccgagaaatatggtttaaccaactcaaaggcaacccctctgaatgttatactcacaccaagactcccttccaatttgtactag

SEQ ID NO: 83 - DNA, 1593 bp, Nigella sativa
atggattcaatatttcatatgtatgcaccaattaatatccttgctgctacctttgtttttattgtcatttctgtgtggtttctgttatggatgaagagatcgagaaagaatagcaagagcagaagagctcctgaaccggtagggggatggcccttgataggtcatttgcgcttgttagtcggccctgagttgccccatgtaatattgggaagcttggctgacaagtatggaccagctctctccatccggcttgggatgcgtcaagcattggtggtcagtaattgcgaggtagttaaagagtgtctcaccaccaatgacagatgcttctccactcgccctagctctgtcgcagtagagttaatgggatataactatgcgtcgtttggtttaggtccttacgggggcttctggcgtgaagttcgcaaaatcgcaattcttgagctcctctcaaatcatcgtttgaagtctcttaaacatgtatggatatctgagattagtggttttgtcaaagaactgtaccaattatgtgtagctaatggcaatacaggaaggcaatctgctttggtggaaatgcgacagtggttaaatgatttgacactaaatgtgtctgtcagaatggttgttggaaagcgatactttggctctggtagtgaacatggtggtgaagatgtcaagcggtttcaaaaggcaattaaagatttctttcgtttggcaggaaaattcacgctggcagatgcaataccattcctaaggtggttggactttggtcatgaaagagccatgaagaaaactgccaaagagttggactatgtacttgcaagatggttggatcaacatcaaaagaacaaactcaattgcgaaacaaagcaggtggatcaagatttcatggatgtcatgttgactgtccttggtgataaagatctgtatggtttcaaggctgatgttgtcaataaggccacttgccttaatttgatcttaggtggggttgacacgacgtcagtgaccctaacatgggcattgtcattgctactaaacaatccaaacattctaaacaaggcacaagaagaaattgatgtccagattggaaaagatagacaagttgatgacaatgacttgggaaaactagtgtacctagaggcaattgtaaaggaaacaatgcggttatatccagcaggtccactgtcaggtgcacgagctgcgatagaggactgcatggttgcgggatatcatgtaccaaaaggaacacgactgattgtgaatacatggaagatacagagagatccagagaaatgggacaaccctagtgagtttcggccggagagatttctgatcaccaccaccaatggccatgtggaagtgtggggtcaacattttgagtacattccttttggatcagggagaagaatttgtcctgccatctcattttcacttcagttggtgcatttgacattggcccgattgctacaagccttcagctttcaaacaccatcaaatgcagcagtagacatgactgagacccctggcctggtcaatttcaaagccaccccgctccaaattttactcactcctcgacttccttccagtttatactaa

SEQ ID NO: 84 - DNA, 1584 bp, Nigella sativa
atgctcagtattcatgattcaaccatggtttttctccaactacaagctatttgtggcatttttggcttcattttcattattacatggtggacaagatggaaaagttccaacaaaatgaaagcaccagaagtagctggtgcatggcctgtaattgggcacctgcatctgcttgggggcggccgtcccttataccagctccttggagacatgtctgataagtatggaccagcttttaccctccgaatgggaatccaaaaggcacttgtagtgagcagctgggaagttgcaaaagagtgtctaaccaccaatgacagagctcttgctacccgcccatcttcggctggagggaagtacatgggttacaacaacgcacttatccccttcagcccttatgggccatactggcgagacatgcgcaagattgctacacttgagcttttatctaatcatagactagaggagttgaagcatgtccgagaaatggaaatcaacacttgtatcagtgacatgtacaaactttgtcaggttgaggatggagttgaaattaaaccaatttctgtagatctgagtcaatggtttgcagatcttaccttcaatgtagtggtgatgatgataacaggaaagagatatattgggtcaactgatgcaggtgacatgaatgaaataagacattttcaggcagcactggttaaatttatgaggctattgagaatctctcttctggtagatgtatttccagttctacagtggattaattatgggggattcaaaggagtcatgaaatcaactgctagagatattgattccgtacttgaaaattggctgcaggagcatcagaggaaaagactttcccctgatttcaatggaaaccatgattttattgacgtgatgatatctaccttagaaggcacagaattctctgattatgaccacaatactatcataaaggcaatatccatggctatggtcgtgggcggcactgatactacaactacaacacttatatgggctatttcccttctattgaataatcctaatgcgatgaaaaaagttcaagaagagttggagatacatgtaggcaaggaaagaaacgtagacggatccgacatacaacatttggtatacctccaagctgttgtgaaggaaactctcaggctatatcctcccgttccactctcagtaatgcaccaggccatggaagactgtgttatcggaagttacaacattcaagcaggtacgcgtgtacttttcaatctctggaagctacaccgtgactcgtcagtgtggtctgatcctttagaatttcgaccagagagatttcttactagccatgttgatgtagacgtcaggggtcaacattttgaactgataccttttgggtctggaagaaggtcatgccctgggatttcatttgctcttcaggtcatacacttgacaatagctcgcttatttcatggattcaatctgacaacacctgggaattcatcagttgatatgagtgagatttctggagctacattatcaaaagttactccattagaagtactagttactccacggctgtcttccaagctttacaattga

SEQ ID NO: 85 - DNA, 1566 bp, Nigella sativa
atggatttcttgatctacgttgctgcctttgccgccgccttcttcttcttattgttctacaacatattatccaagagaataaccggtacaaagagaagaattgctcctgaacctgctggtgcatggccttttattggtcacttgcccatgctcttcgggcccaacttaccccatgtaacgttgggtgccttggctgacaagtatggaccagctttcactatccagctgggcttacacaaagctcttgtggtgagtagttgggaggttgccaaggactgcttcactgtcaatgacaaagccctcgccactcgccctacctctgctgcagtgaagattatggcctacaactgtgccgtgttcagtttctcaccatatggttcatactggcgtgaagcacgcaaaatagctatacttgagcttctttcacaccataggcttgatttgttaaaacatgttcggaaatctgaagtaagcacatctataagagaactgtaccaattttggcaaaaaaatgctacggaagttactaaatttgctcagctggaaatgaagcaatggtttggtgatttgacaatgaacctgattgtcaggatggttgctggaaaaagatatgctagtgttcaatcagatgatgatggtgaggggaaaaggctacaaaaggccgttaatgatttcttccatctagtagggttgtttgtggtatccgacgcacttcccttccttggttggttagatattgggggcaacttgaaaaccatgaagaaaactgccagggaacttgacagcataatggagtgttggttgaaggamcatcaagctcggagatcaaatggggagcaagatttcttggatgtgatgttgtccatactgcgtgaagataataagctgcaagagtatgatggtgatgttgttgtcaaagctatgtgcttgaatatgattttgggtggagctgatagcacaacaatcactctaacatggaccatctccttactacttaacaacagacacattttgcagaaagcccaagacgaaattgacagcaaagtggggaaagatagacaagtgaatgaatctgacatagagaaactagtataccttcaagcaattgtraaggagactttgcgtctgtacccacctgctcccctatcttcacaacatgaagccatagaggactgcacaatagctggctaccacatcccagctggtacaagattaataacaaatctatggaaaatccaacatgatccaagtgtatggcacaatccttccgagtttcagccagagaggttcctcactacccaggcgaatgtggactttagaggtcagaatttcgagtttattccatttggatttgggcgacggtcatgcccaggtacctcacttggtcttcaaatggtgcacctgccattagcacgtttgctacaaggctttacatttgaaacaccatcaaatgcagctgtggacatgactgaaagtgctgggcttacaaatcacaaagtaacaccacttgaggttctaatatcaccacgtctccgtttcgatctttatcaagaatctcccccttga

SEQ ID NO: 86 - DNA, 1580 bp, Nigella sativa
attccttcaaccaaacatatactggttttatctgcttatctgtctttgcctccttcttcttcttcttcctttacagcgtgcagcagaagaggagaacaggtagaaaggccagatacgctcctgaacctactggtgcatggcctttaataggtcacttgccaatcttgttcgaacctaacttaccccatatacagttgggagccttagctgacaagtatggaccagtgttctctatcaaacttggcttacggaaggctcttgtggtaagcagctgggaagttgtcaaggagtgcttcactgtcaaagacaaagtccttgcctcccgccctagctcagttgctgtgaagataatgggctatgattatgccgtatatgcattcggaccatatggatcatattggcgtgaagctcgcaagttaactatacttgaacttctctcagaccatcggcttgatttgctaaaacatgttcgggtctctgaagttagcatgtctatgaaagaactactcaaattctgccaaaagaatgccaataatgtcagtggaaaagctttattagtagatatgaagcaatggttcggtgacttgacattaaatgttattgttaggatggttgctggaaagagctacttgggtgctagtgcaaaattggaagacggcgaacagaaacggttacaaaacgcaattcatgagtttttccgtttggcggggctatttgtggtgtcagatgcacttccaattcttagctggttagacattggggggcatgagaaagccatgaggagaaatgccagggagattgacaagataatgagcagttggttggatgaacatcgacgcaataaattggccggggtaacaaatggagagcaagactttatggatgtattgttgtccaaatttgagaatagtaatctccctggatatgaacctgatgttgcaatcaaggctatttgcttgaatatgattttaggtgcagctgataccacaatcgtcactctaacatgggttgtgtctttaatacttaacaaccgccaaattttgaagaaggcacgagaggaaattgagaataaagttggaaaagataggcaagtgaatgaatctgatatagagaaactagtatacctccaagcaattgtgaaagagacgttgcgtttatacccagctgctcctctatcagcacaccatgaatccatggaggactgcaccattgctggctaccacgtcccagccggtacacaattaataacaaatttgtggaagatccaaagggatccacgagtatggcctaatccttgcgagttcctaccagagaggttcctcaccacgcatgcaaacgtaaactataagggtcagaattttgaattcattccatttggatatggtcgaaggtcgtgcccaggtatgtcatttggacttcaaatggtgcacttagtattggcatctcttctacaaggctttgaattggaaactccattgaatgaggcggtagacatgactgagagcgctggacttacaaatctcaaagcaacgcctcttgaagttctaattactccacgtatgcctttgaatctatactga

SEQ ID NO: 87 - DNA, 1530 bp, Nigella sativa
gtaactgttatctacttatttacatttgccatcttcttctacctctacagcatattatggaagaacccaagaaagagtgcaaagaccagagttgctcctgaaccagctggtgcatggcctttcatgggtcacttgcctatgctattggaacccaacttgccccatataaagttgggagccttagctgacaagtacggaccagccttcactgtccaactcggcctccacaaggctctagtggtgagcagttgggaggttgccaaggagtgcttcactgtcaatgacaaagtcctcgcagatcgccctagctcagttgcagtgaagataatgggctatgataatgctgttttcgcctttggaccatatggttcttactggcgtgaagctcgaaagatatctacagttgagcttctctcgaaccatcgtcttagtttactgcaacactttcgaatttccgaagctagcatgtctatgaaggagctatatcaactttgtgccaataacgggaaggctttggtggaaatgaagaaatggtttggtgacttgtcattgaatgtaattgtcaggatggttgccggaaagaggtatgccaaagctagtgaagatgatgaacggagacagttacagaaggggcttaaagatttcttttatttggtaggattgtttgtagtgtcggatgcacttccaattctaagttggttagacattgggggccatgagaaagccatgaggagaaccgccaaggagcttgacaccataatggagaggtggttagatgaacatagacgggctaaattggctggggtgacaaagggagaacaagacttcatggatgtgttgttgtccatacttgaagatggcaagcttcctcactatgaatctaatacagttaacaaagctatttgcttgactatgattttgggtgcagctcataccacaacagtcactctaatttggacattatcgttactacttaacaatcgacatattttaaacaaggctcaagatgaaattgattccgaagttgggaaggatagagcagtgactgaatctgatataaagaatctagtatacctccaagcaattgtgaaggagacgttgcgtttatatcctgctgcacctctacctgcccaccgtgaagtcatggaggactgcatcatagctggttaccacgttccagttggtacaagaataataacaaatttatggaagattcaacgagatcctcgtgtatggtctaatccttgtgccttccaaccagagaggtttcttactactcattcaaatgtggactttaggggtcagaattttgagttcattccatttggatctggtcgaagatcatgcccaggtatctcacttgggcttcaaatggtgcacttggcattagcgcgtctgctgcaaggatttgagttagaaactcctttgaatctgggaatagacatgactgaaagttctggacttacaaatcttaaagtaacaccgcttgaagttgtgatcacaccacgactaccttcaaatctatactga

SEQ ID NO: 88 - DNA, 1689 bp, Papaver bracteatum
atggcgtatttgatgatcaagaaatctttccacttgttttccgatcaaccaacttcagtttccactcttatagtacttgcttttctactgacactttcacctgttattatttactatgaacagaagaagaggggtttgaggcgaaatcggacctcatcgtcatgtaccgcaattacaacgactccgttaccagaggcatcaggtgcgtggccagtgataggtcatcttcttcttttcatgaacgaaaacgatttaaatcatgcaactctcggtaacatggctgataaatatggacctattttcagcttaagattcggtagtcatagaactctagttgttagtagttgggagatggtaaaggagtgttttacaggtgccaatgacaagtttttttcaaatcgtccttcctccttggcggttaaacttatgttttatgacactgagtcttatggctttgcaccgtatgggaagtactggagagagttgcggaagatatctacacataaactcctctctaatcagcaattagacaagttcaaacacttgcggatttctgaagtggacaactcctttaaaaagcttcacgacttatgcagcaacaacaaactgggaggagaaactacatctgtggctaatcttgtgagaatggatgattggttcgcttacttgacattcaacgtaataggacggattgtcagcggattccaatcaaatgcagtgtcaggtgccacaagcagccaggaaaaatacaagcttgcaatcgatgaagtgtcaaatcttatggcaacatttgccgtttcagatgtggttccatgccttgggtggattgaccgattgactggtcttacaggaaagatgaagaaatgcggaaagaaattagatgcagtagttggggatgcagtggaggttcatcgccaaaagaaactcaaaatttctagaaataccgcaggagaacttacggagcatgaagaagaagacttcatcgatgtttgcttgtcgattatggagcaatcacagattccgggaaacaaccccgaaatctctgtcaaatctattgccttggacatgttatcgggtgggagtgacactacaaagttgataatgacatggaccctttctttgctgttgaaccatccagacatattggacaaggctaaagaagaagtagatacatacttcaggaagaaaaagatatcggataacacacctgtggttgatgctgccgatgttcctaacctcgtctacatccaagctatcatcaaagaatcaatgcggttataccccgccagcacattgatggagcggatgaccagtgatgattgtgaggttggtggcttccacgttccagctggaacccgactatgggttaacgtatggaagatgcaacgagacccaagggtttggaatgatccattggtatttcgacctgagagattcttgagcaatgacaaagggatggtagatgtgaagggtcagaattatgaactgataccattcggaacaggcaggcggatatgtcccggtgcatcttttgccttagaagtcttgcatttggtcctcactcgtcttattcttgagttcgagatgaaggcaccagagggggaaattgacatgagggcaagaccaggttttttcaacaacaaggtagtgccactagatgttctactcaccccacgcacactagattaa

SEQ ID NO: 89 - DNA, 2561 bp, Papaver bracteatum
atgaataactactcatcatcacctgcatcatcaacagaaacagcggtactttgtcatcagcggcagcagtcgtgtgcattgccaatttccggtcttcttcacattttcatgaataaaaacggcttaattcatgtaactcttggaaatatggcggataaatacggaccgattttcagtttcccaacaggtagccatagaattctcgttgtgagcagttgggagatggtaaaagagtgttttacaggcaacaatgacactgctttctcaaaccgtcctatcccgttagcttttaagactatattctatgcatgccgtggcatagactcatacggtctttcgagtgtaccttatggaaaatattggagggagctacgaaaggtctgtgtgcataacctcctctctaatcaacaactactcaagttcagacacttgataatttctcaagtcgatacgtctttcaataagctgtatgagttatgcaaaaactctgaagacaaccagggaatggtgagaatggatgattggctcgcccaattatcgttcagtgtgataggaagaatagtctgcggattccaatcagaccctaagacaggtgctccaagcagggtggaacaatttaaagaagcaattaatgaagcatcttattttatgtcgacatctccagtgtcagataacgttccgatgctagggtggattgaccaattgactggtcttacgagaaatatgacgcactgcggaaagaaattagacttggtggtagagagcataattaatgatcatcgtcaaaagagacgattctctagaactaaaggaggagatgagaaggacgatgaacaagatgacttcatcgacatttgcttgtcaataatggagcaaccacagcttcctggcaacaataaccctcctaagatacctatcaaatctattgtcctggacatgataggtgcggggactgacaccacaaaactgaccatcatttggaccctttccttgctgctgaacaaccccaatgtgttggccaaggcaaaacaagaagtggatgcacactttgaaacgaaaaagagatcaacaaacgaagcatcagtcgtggtggatttcgatgatattgggaaccttgtctacatccaggcaatcatcaaagaatcaatgaggttgtatccggtcagcccagttgtggagcgactgagcagcgaagattgtgtggtcggtgggtttcatgtaccagcagggacgagattatgggctaacgtatggaagatgcaacgagaccctaaagtatgggatgatccattggtgtttcgaccagagagatttttgagcgatgaacagaagatggttgatgtaaggggtcaaaattatgagctgttaccatttggagccggtcgacgtatatgtccaggtgtatccttctctctggatctaatgcaactggttctgactcgtcttattcttgagtttgaaatgaagtctcctagcgggaaagtggacatgacagcaacaccaggattaatgagttacaaggtggtccctcttgacattctgctcacccatcgtcgcataaagtcgtgtgtgcagttagcatcctctgagagagacatggagagtagtggtgtaccagtaatcactctgagatcgggcaaggtgatgcctgttttaggcatgggaacatttgagaaagctggtaaagggtctgaaagagagaggttggcgatattaaaagcgatagaggtgggttacagatacttcgacacagctgctgcatacgaaactgaagaggttcttggagaagctattgctgaagcacttcaacttggcctaatcaaatctcgagatgaacttttcatcagttccatgctctggtgcactgatgctcaccctgatcgtgtcctcctcgctcttcagaattctctgaggaatcttaaattggagtatgtggatctatatatgttacccttcccggcaagcttgaagccagggaagataacgatggacataccagaggaagatatttgtccaatggactacaggtctgtatggtcagccatggaagagtgtcaaaaccttggcctcactaaatcaatcggtgttagcaatttctcctgcaaaaaacttgaggaattgatggcgaccgccaacatccctccagccgtgaatcaagtggagatgagcccggctttccaacaaaagaagctgagagagtattgcaacgcaaataatatattagtcagcgcagtctctatactgggatcaaacggaaccccatggggctccaatgcagttttgggttctgaggtgcttaagaaaattgctatggccaaaggaaaatctgttgctcaggttagtatgagatgggtttacgagcaaggcgcgagtcttgtggtaaaaagtttcagtgaagagagattgagggaaaacttgaacatattcgactggcaactcaccaaggaagacaatgaaaagatcggtgagattccacagtgcagaatcttgagtgcttattttttggtctcacctaaagggcctttcaaatctcaagaagagttgtgggatgacaaagcttg

SEQ ID NO: 90 - DNA, 1623 bp, Papaver bracteatum
atggagttcttgatgaagttattattgttacttgaaccaatcacttttagtatttttcttggtataggttctattgttcttctatacaatgtcttcttcttggttattaacaagaaaaagaagaagaaagcaccaaatgcatcaggggcatggccgttgataggccatctcaatcttttcatgaatgataaggaagcgttgtataaaacactaggaaccatggccgacaagtacggacctgcattcaacgttcgattaggcaaccaagaaatccttgtggtgagtaattggaagatggtaaaagaatgttttaacactcaaaatgataagctattttcgaatcgtcgaactacattgggtgtgaaatacatgcttaacaagaagacctctgttgccttttcaccatatggaacatattggagggagctacgaaagctaacggtgcaacaattgctctctaagcaacgtttagattcgtggaaacatttgaaaatcaaagaaatagatgcttcatttggtagacttaacgatttatgcagcaacaacaagggtactggagcagctaccccaattaggatggacagttggtttgccgagttgacgttcaacgtgttcgcaagaattgtctttggctaccaaagtggagaaaggttgatgctatcaggtgatacggcatccaacggggagaggtacaagaaaacattagaagaagcatttctccttatgtcaagctttgcggtttctgacgtattcccatgcttagagtgggtagacagatcaagaggccttgtaaggagcatgaaacgctttggagatcagctaaattcaattgcagggtgtcttattgaggagcatcgccaaaagagatcacaatccgtatcagcatcaaattctacaaatgataaaggagttggtgatgaacaagacttcattgatgttctcttatcggttgctgaactatcacaaattcctggagatgaccctgatttggtcatcaagtctatgattttggaagccttagcaggtgggagtgacacaacaacatcaaccctaacttgggttctttcactgctattgaaccaccccaaagtgttaaagacggcaaaagaggaaatagatatgcacgtcggacgtaatcgatgcgtagaagagtcagatattcccaagctcgtttatgtcaatgcaattatcaaagaatcaatgagattgtatccaaatgggtcattggttgatcgattgacgttggaagagtgtgaagttggtggattccatgtcccagctgagggacacttattcgtaaacgtttggaagatccatagagatccgagtgtgtgggagaatcctctggagttcaagccagagagatttttgagtaatgattgcaaggtggatatggatttcataagtcaaaaatatgaattcataccattcgggataggtcggaggatatgtcctggtatgctttcagcattacaggtgatgcattttgtggtagcccgtcttattcatgggtttgatatggaagcagcaagtgccgatgggaaagtggatatggcagaaaagccaggcatgacttgctataagatgacacctcttgaagttatgctcacggctcgacagtag

SEQ ID NO: 91 - DNA, 1647 bp, Papaver bracteatum
atgtatccggtaaaccagttgcagagtcaagcaattgctgtgctatgtgccgtaattgtcttcatcttctatttggggagaaagttgtttaacagtacccatattcataagcctggaaagacagcaccagaaccagcaggcgcatggccgattataggtcatcttcacctccttgggggagcaaaactcatgtaccgaaccctaggttctttggcggacgaatacggaccagttttcatggttcgacttggtatgcgacgggttcttgtaattagtaacacggcgtcagctagagagtgtttcactacaaatgataaggtttttgctacccgcccaaccacagttgctataaagttgctgacttacaatcacaccatgtttggttttgcaccttatggaccttactggcgcgagatacgcaagatagcaacaacggagctcctatcggatagacgtctagccatgctcaaaaacgtgtggatctctgagattaatttgtgcataaatgaattacatcaactcttgatggacaagaatagtagaaaagtagatcatcatcaacatgtttacaaccaaaatatggacccaatttcggtggagatgaacggatggtttgcagatttgtctttcaatgttgtggccagaatgatagctgggaaaagatatttcggaaagaacaccgatggtggcgaagaagaaaccaggaggtatcgggaagcaatgaatgattttatgcacttggtagtgatattattggtgtctgatgctgttccatttttagggggtttagacttccagggatataagaaaaggatgaagaaaactgccaaggaaattgattattttctgggtaaatgggttgatgaacatcgacagcgtttgaaatataaaaacatatccaaggttgatcaacaagatgatttcattgatgtgttactgctgaatttaaatgatcaaccgatctatggtcgcgatactgatacaatcatcaagtctacttgcctgtctcttatcgcaggtggtagtgacaccacagcagttaccctaacttgggcactatcgttactgctgaacaaccaacacgtgttaagaaaggctcaggacgagttggacatacacgtaggcagggaaagacaactggaagaatcagatatcaagaacctcgtttatctccaggccatagtgaaggaaacattgcgtttatatccagctgcaccgttatcagcaccaaggatggcaatggaagattgtacggttgcgggattccaagttagtaaaggcacacagctgatgcttaatgtatggaaactacatcgagacccgcatttttggggacctgatcctctggagtttaggccagagagatttcttactgctgatggtagtagcacgggaagtggtcattgcattgatattgatgttaagggtcggcattatgagttactaccatttggatctggtagacggatgtgcccaggagtttcatttgccatgcaagtcgttcatctgacgctcgctactttacttcacggatttcatttatcgacgccaacagatggtccagttgatatgactgaaacttcaggacttagttgccccaaagcaaccccattagaagttttgctcactccacgtctgccctgttag

SEQ ID NO: 92 - DNA, 1704 bp, Papaver bracteatum
atggatgtggcaatcatcgtcgatcaccactacttgcagccgttcgtgagtattgcaggcttattagctttgctatccttcttctattgtatttgggtctttattataaggccaaggattatcaaaagcaacttagacgagcgcaaattatcaccatcatctccacctgaagttgcaggtgcatggccgatagtagggcatcttcctcagctaataggatctacacctctattcaagatccttgcggatatgtctaacaagtacggacctattttcatggtcagatttggtatgtatccgaccctagtagtgagcagttgggagatgtcaaaagaatgcttcactaccaacgataggttattcgctactcgtccacctagtgcggccggaaagtacctcactaaagccttgtttgccttttctgtgtatggtccttactggcgggagatccgtaagatctctacaatccatttactctcacttaggcgcctcgagttacttaagcatggacggtacttagagatcgacaaatgcatgaaaagattatttgaatattggatggaacatcataagaacatcataagcacaactagttcagttaaggtcaacatgagccaagtgtttgcagaactatccttaaatgtggttttgaagataatagttggaaagaccctttttattaaaaatggtaatgaagattacaccaaagaggaagaagaaggccaaaagctccacaagactatcctaaaattcatggaactagcgggggtatcagttgcatctgatgttcttccattccttgggtggttggatgtggatgggcaaaagaaacaaatgaagagggtctacaaggagatgaacttgattgcttcaaagtggcttggagaacatcgagagagaaaaagactgcaaataatacaaaaacgcggagcagcaagaggcagtaattatgatgatgggaatgacttcatggatgtgttgatgtcaattcttgatgaagaaaacgatgatctcttctttggttacagtcgagatactgtcatcaaatctacatgtctgcaacttatagtggccgcttcggatacaacgtcacttgcaatgacatgggctctctcactgctgctcaccaatcctaatgtcttacagaaggctcaggatgagcttgataccaaagttggcagggacagaataatagaggaacacgatatcgagtgtctcgtctacctccaagcaattgtcaaggaaacactccgattgtaccctcccgctccactctccctaccccatgaggctatggaagactgcactgttggtgggtaccaagtgaaagcaggcacacgcttagtagttaacctgtggaaactgcagcgtgatcctcgagtgtggtcaaacccgttggagtttaagccagagaggtttcttccacagtcagatggtggttttggtggtgaagaagcaagaatggacttcaggggacaacattttgagtacacgccatttggatcagggagaaggatatgcccaggtatcgactttttcctccagacagttcacatggcactagctcgtcttcttcaggcatttgatttcaacacagctggaggactagttatagacatggtggaaggtccaggtctaaccatgcccaaagtaaccccacttgaagttcacctaaacccacgtctgccggtcacactttactag

SEQ ID NO: 93 - DNA, 1677 bp, Papaver bracteatum
atgcaggtggattggccaaacatcttacagaagtactacccaataataacatgttcattattaactttgctatccttctattatatatgggtctccatcacaaaaccaagcaggaattcaaaaaccaaattaccgccacctgaagttgcaggttcatggcctatagtaggtcatcttccacagctagtaggatctacacctttgttcaaaatccttgctaacatgtctgacaaatatggacctatcttcatggtccggtttggtatgcacccaaccttagttgtgagtagttgggagatgtctaaggaatgcttcaccaccaatgacaagttcctcgccagtcgtccacctagtgcttcagccaagtacctcggttatgataacgccatgtttgttttctcagattatggtccttattggcgtgagatacggaagatctctactctccaattactcacacacaagagactcgattcgctgaagaatatcccttacttagagatcaacagctgcgtgaaaacgttatatacccgttgggcgaaaacccaaagccagataaagcaaaatgttggaggtgcagctgacgattttgttaaagtcgacatgacagaaatgtttggacatctaaacttaaatgtggtgttgaggcttgttgtaggaaagcctatttttatccagaaagacaatgctgatgaagactacacaaaggatggccataacaaagaggaattaggtcaaaagcttcacaagactatcatagagttctttgaattagcaggtgcttcagtcgcatctgatgttcttccatatcttgggtggcttgatgtagatggacaaaagaaacgcatgaagaagatagccatggagatggacttatttgctcaaaaatggcttgaagagcaccgacaaaaaggaatcaatcatgataatgagaatgacttcatggccgtgttgatatcagttcttggtgaaggaaaggatgaccacatcttcggttacagtcgggacactgtcataaaagccacatgtttgacacttatcgtagcggctacagacaccactttagtgtcattgacatgggctctctcactactactcaccaatcctagagtcttaagcaaggcgcaagatgagcttgacacagtagtcggcaaggaacgaaacgtagaagatcgagacgtcaatcacctggtctacctccaagcagtcatcaaggaaactctccggttgtaccctcctagcccactcgccgtaccccatgaggctattgaaaactgtaatgtgggcgggtatgaagtgaaagcaaggacacgtttattggttaacttgtggaaaattcatcgtgatcctagagtatggtcaaacccgttggagtttaagccagaaaggtttctcccaaaactggatggaggtactggtgaagcttctaagttggacttcaaaggtcaagattttgtgtatacaccattcggttcgggacgaaggatgtgcccagggatcaactttgccagtcagacgcttcacatgacgctagctcgcctactccatgcattcgattttgacattgagtcaaatggactagtaatagacatgacggaaggttcaggtttaaccatgcccaaagtaaccccactccaagttcaccttcgcccacgtctccctgccacactttactag

SEQ ID NO: 94 - DNA, 1716 bp, Papaver bracteatum
atgatggatctagcaatgttcatcgatcaatacttctcattagctaaaattgcaggcttattagctttgttatctttcttctattatctatggatctcaactttgtggtcgccaaggaatcccaaactatcatcagtatcaccacctgaagttgctggtgcatggcctatattaggccatcttcctcagctactaggatcaagacctctattcaaaatcctagcagacatgtctgacaattatggtccgatcttcatggtccggtttggtatgcatccgaccttggtggtaagcagttgggagatggctaaagagtgcttcaccaccaacgacaggttcctcgctggccgcccatcgggtgctgccaacaagtacctcacgttcgccctgtttgggttttccacatacggcccttactggcgagagatccgtaagatcgctaccctccatttactctcacataggcgtctcgagcttctcaagcatgttcctgacttggaggtcaccaactgcatgaaacacttgcatcgacgctggatagacagtcaaaaccaaataaaacaaaatgacgctgcagctggttcagtaaaagttgacatgggcagagtatttggcgagctaaccttgaatgtggtgttgaagttagttgctggaaaatcaatttttttcaagaacgacaacactcgtcaatatgactccaaggatggtcataacaaagaggaggaagaaggtaaaaagctccataagaccatcatagatttctactcattagcaggagcttcggttgcatctgatgttcttccatttcttgggtggttggatgtggatggacaaaagaaacgcatgaaaagggtagccaaggatatggatttcatcgctgcaaagtggcttgaagagcaccggcatcaaaaaagacaaacagtactatcaagctcagcaacactaggcagcagtaatcatgacgatgcgaaagatttcatggacgtgttgatgtcaattcttgatggggaaaatgatgatctcttctttggttacagccgtgacactgtaatcaaaaccacatgtctgcaacttatagcagctgccgcagataccacatcagttacgatgacatgggctctcgcactactaattactaatccgaccatattaagaaaggctcaggatgagcttgataccaaagtaggcaaggacagaaacatagaggaacgcgacatcaatgatcttgtctacctccaagcaattgttaaggagacactccggatgtaccctgctggcccactcaacgtaccccacgaggctatcgcagactgcaatattggtgggtatgaagtgagagcaggcacccgtttgttggtaaacctatggaaaatgcaccgcgatcctcgagtatggtcaaatccgtcagagttcaagccagagaggttccttccacaactggatggtggatctggtggtgaggcggcaaacttggacttcaggggtcaagactttgagtatctaccttttagtgcaggaaggaggatgtgtccagggatcgacttttccctccaaacgcttcatatgactcttgcgcgcctgcttcatgggttcgatttcaacaatgactcggcaggaataataatagacatggaggaaggttcaggtttaactatgcccaagttaacaccactagagatttacctctgcccacgccttccagccaaactctactag

SEQ ID NO: 95 - DNA, 1632 bp, Sanguinaria canadensis
atggagtttctttctctacaattccaaccgattaccatttttgcccttcttcttgccactcccatttttctgtacaatctctggaattatggaaggaaactcaacaacaagaacaagaagagcagaaaaccaccagcacctgaagcatcaggtggatggccgatcatgggtcattttcatcttttcaatggaaccgaggtgactcaccgagctctcggttccatggcggacaaatacggtccagctttcaatatccgaatcggttctcatccaacacttgttgtgagtagttgggagatcgctaaggaatgtttcaccacaaacgaccgactcttctcaaataggccaggttctttagcgattaaactcatgttctacgatgccgattcggttggttatgcaccgtacggaacttactggagagagttgagaaagatttcaactctaaaacttctttcaaatcacagattggaaacgcttaaacatttgagaacatctgaagttgaatcctgttttaagcagcttcatgatttgtggcggatgaacaataaaaagggggggagcgatgatggatcagattttgctctggtgaggatagataattggtttggtgatttgacttttaatgttgtggcgagaattgttgccgggaaaaagaattttgcgggaggtgcggcgagtggtgatgccggagctcaaagatataaggaagccatggatgaagcgtttcgtttgatgacgaggtttgcgttctcagatgttgttccatcgcttggatggttagataaattgacaggacttgttggaggaatgaaacgttgtggatctgaaattgattcgatcgttgcaagttgggtggatgaacatcggttgaaaagaatttctggaaaagaaggggatgatcttgaacaggatttcatcgatgtttgcttagagattttggagcattctactttgcctggcgatgatcctgaagttgtcatcaaatctacttgcctggacatgatattgggtgggagtgacaccacaacagtgaccctaacatgggccctctccttactattggaccatccccacgtgtggaaaagggcgaaggaggaagtggatgcacacgtgggaaaggagagacaggtggaggactcagatatccctaatcttgtgttcatccaagcaatcgtcaaagagacgatgagattgtacccagctggaccactgatcgagcggaggacaatggatgattgtgaggtaggtgggttccacataccaggtggcacacgtttaattgtgaatttatggaagattcaaagagacgggagcgtgtacaaggaggatccattggagtttagaccagagaggttcctgacgagcaacgcggaggtggatctaaagggacagaattacgaactgataccatttggtgctggaaggaggatatgtcctggagtgtcgttcgcagtgcaattgatgcatttggtactggctcgtctcattcacgacttcgaaataacgatgcccatgggtgcgaaagtagacatgactgagagtggaggactaatcagccacaaggtgacgccgctggaagtgctgctcaaaccacgcctcccctcgctccaacaagcagctttatattaa

SEQ ID NO: 96 - DNA, 1578 bp, Sanguinaria canadensis
atggaatattcctcagtacttctccattggttccctgcttccatggctgcccttcttgccttggtttttctgtacaatctcatctttaattccccaaaaaccggtaataagaagattataaggagggcacccaaagcagccggtgcatggccagtccttggtcacctccatttgtttggatcaggtgagctgcctcacaaaatgctcgcagccatggcagaaaaatacggccccgccttcacaatgaaattcggtaagcacacgacactagttgtgagtgacacccgcgtcgtaaaagaatgtttcaccaccaatgacaccctctttgccaaccgtccatccaccaaagcctttgatctcatgacttacgccaacgactcggtagccttcacaccttacagtccttattggcgcgagcttagaaagatatccactctcaaacttctctctaaccaccgcctccaatcgatcaaggaagtccgagtctccgaggtgagcgtatgttttagggagctatacgatatatgcaaaaatgatggaggaggagctcctccagttttggtggatatgaagaaatggttcgaagaggtctcgaacaacatagtgatgagggtaatcgtagggaaacaaaattttgggtcgaagattgtttgtggcgaagaggaagccgtcaattacaagaacgtcatggatgagctcctacgtcttgctagtgtgtctatgttatcggatgtggcacctttacttggttggttggatatgttccaaggacacatgagcgccatgagacgaaatgggaaaaaactagacaccatacttgagaggtggttggaggagcatcggaagaagaagagtgaggatgagcaagatttcatggatgttatgttgtcgatcgttgaggagactaagttgtctggccgcgacgctgataccgtcattaaagctacttgtctggccatgatcatgggtgggacagacaccacggctgtgagtctaacatggatcgtttccttattgatgaacaatcgctatgcattgaaaaaggctcgagaagaattggacgcgctcgtggggaaagatagacaagttgaagattcagatttgaagaatttggtgtacttgaatgccgtcgtcaaggaaacgatgcgattatacccgttgggtactcttcttgaacgtgacaccaaagaagattgtgaggttggtgggttccatgtggaaggcggtacgcgtttactagtgaatgtatggaagttacaacgagacccaaacgtgtggaatgatccattagaatttagaccagagagatttctaacagagaatgcggatatagatgtcggaggccaacatttcgaattactaccatttggggcagggagaagggtgtgcccaggagtgtcgttcgcactccaattcatgcatttggtattggctcgtctcatccatggctatgaattgggaacccaaaatgatgaggatgtggatctaactgagagcacagaaggacatgttaaccacaaagcctccccgctcgatctcctcatcaccccacgcctccaccctaaactttatgaataa

SEQ ID NO: 97 - DNA, 1584 bp, Sanguinaria canadensis
atggattattcatcccatttgaaccagttctacggggtagctccatacatggctgccctactaattgccttagtgtttctctacaatattctttgggcttccccaaaaaccaccaacaagaaaccaatcatggcagccggggcatggccaattctaggccacctccatctgtttaaagatggggaattgcctcaccacatgcttaaatccatgtctgataaatacggccctgccttcctcatgaagttcggccaacaccgaacactcgttgtgagcaactaccgcatggtaaaagaatgtttcactactaatgacacccacttttgcaaccgtccatccaccacagccttcgatgtcatgacttacgctaatgactccgtcgctttcacagcttacagcccttactggcgtgagcttagaaagatttccactctcaaacttctctctaacaaccgtctccaggccatcaagaacctccgagaagccgaggtgaacgtatctttcagggggttgtatgatttatggaagaataatagtgatcgagctgcgtcggttttggtcgatatgaagaaatggtttgaagaggtctcaaacaacgtcgtgattagggtgatcgtggggaaacataattttgggactaagattgtgaagggtgagaaggaggctgtggaatacaagacgatcatggatgagctcttacgtcttgctagtttgtctttgttatctgattttgctcctatacttggttgggtggacttctttcaaggaaacgttcgaaaaatgaaacgaaatggcaagaaactagacgtggtacttcagaggtggttggagacgcatcggaggaagaagaactcaccagaggatgaacaagacttcatggatgttatgttgtcgatcgttgaggagggcgacaagttgtctggccaccacgctgatactgtcattaaagctacttgcttggccatgataatgggtgggacagacacgtccgcagtgagtctaacatggatcgtctccttactgatgaacaatcgtcatgcattgaaaaaggctcgtgaagaattggatatgtacgttgggaaggataggcaagtagaggattcagatttaaaggacttggtttacttgcatgcaatcgttaaagaaaccatgcgactgtacccactgggtactcttcttgaacgcgagaccaaagaagattgtaaggttggtgggttccacgtcgaagccggtacgcgtttactagtgaacatatggatggtacaacgagacccaaccgtgtggagtgatccaacaaaatttataccagagaggtttctaacagagaaggcggacatagatgttgggggtcagcatttcgaactcataccattcggggccggtagacgggtgtgccctgccgtgtcctttgcactccaatttcttcacttgatactggctcgtctcatccatggatatgaattaggaaccccaaatgacgcggatgtcgacttaaccgagagcccggaaggacatgttaaccacaaagcatcccctctcgaactcctcctcaccccacgcctcgaccctaagctctatatatga

SEQ ID NO: 98 - DNA, 1608 bp, Sanguinaria canadensis
atgaattcaatcgcagtcgtcggtgttcttcttttcttcctctactatctatggaggacactattcaccactcacaaagcggcgccaccaccacaaccagccggagcaaggcctattataggtcacctacatctcctcggtggagcgaatcaactagtccatcaaacactcggttccatggcagacaagtacggatcaattttcatgatccgactcgggatgcgacgagtcctcgtggtgagtagctccgagttagctaaagaatgtttcactacgaacgacaaggttttcctcaaccgcccaagttcattagctttaaagctgatggcctacaacaacgccatctttggttttgcaccttttggtccttactggcgtaagatgcgcaagatagcagtcaccgaacttctatccaacagacgcctcgagatactaaaaaacatcaggatctccgagatcaacatgtctataaaagaattacatcaactatgggtagatatgaacagtggtgatgatcaagtggggggcccaccaattgtggtggaaatgagaaagtggtttggggatttatcgttcaacgtggtgggtagaatgatagctgggaaaagatattttgggaggaattgtgattgtgatgaagaagaaacgaggaggtatcagaaggcgatgggtgattttatgcatttagtgggggtttttgtggtgtcggatgcgattccgttattagggtttttggatttacagggatatgagaagaagatgaaaaggacggccatggacattgattgtgttttagggagatgggttgatgaacatcgacgacgacgacaagaccacgatgagaagaggattatggtctccgatgatgatcatcaaggacaagatttcattgatgtgatgctatcgatcttaaatgatgatgatcagttctacggttacgatgctgatacagttatcaagtctacctgcctgtctcttatcgcaggcggccacgagaccacggcggtcacactaacatgggccctctctttactactaaacaatcgacacgtgttacaaaacgcgcaagatgagttggacatccacatcagcaaggaaagacaagtggacgaatcagatatcaagaacctgaaatacctccaagccatagtcaaggaagcattgcgtttatacccagctttaccactttcagcactaagattggccatggaggactgcaccatagctggatttcatgtccctaaaggcacagaattgatgcttaatctatggaaattacatcgagaccctcacgtttggtctgaccctttggagttcaagccagaaaggtttcttactaatagcacccatgaagaagttgacgttgggggtcaacattacgaattactaccatttgggtctggtagacggatgtgccctggggtatcgtttgctcttcaagtcctgcacttgacgcttgctcgtctacttcatggatttcatttgtcgactccgtccggtgtacctgtggatatgactcaaagttttggccttagttgcccaaaagcaactcccttggatgtcctccttacaccacgtctcccttcaaagctatattatgtagcataa

SEQ ID NO: 99 - DNA, 1806 bp, Sanguinaria canadensis
atgatttcaactacgccggacgtactagctacctcatcatattcatcatctaacaagcatatggattcagatcatctttaccggttctcaactagtactagtatagttattggcctctttattttactattcttccttgtgctcctatggaaaccaaagaagcagtctgctacttctaagactaacaaaccaactagagagcagcgggcaccggaaccttctagttcatggcccataatcggtcatctccgtctcttcggaggaccaaatagccttccccacataacattgggagctatggctgataagtatggaccagtcttcaccatccgaatgggttcgcgtccagtgcttgttgtgagtagttgggagacggcgaaagaatgtttcaccaccaacgacagggtcttcgcctctcgtccacgcactatagccattaaacatatgtgttatgaacatgtcatgcttgggttcgccccttacggatcatactggcgggaattgcgcaagatagtgaaccgagagcttctttcgaataatcggctagagttgttaaaacatgtatggggatctgagattaacacatccattaaagaactgtatgagttgtggttggtgaacaaaaacaacattgaagcagaaggtgaaaatgaaggtacaagtgatagggttttggtggagatggagagatggtttgcggatttgactctaaacatgtctattaagattgttgttgggaagcgatacccctccggtgttactgccggtggtagttctggttgtgatgatgatgaagctcagaggtgccggaaggccctgagagatttctttaagctggtgggtctgtttttggtgtcggatgcgatcccctttctaaggtggttggacttgggtggttatgaaagagagatgaagactactgcaagagagttggactgtttaatggaggaatggttggaagaacataaaatgaagaggagattattaatttcaccgtcggcaggtgatcatcatgaagctgcagagatcatgatcaataagcagaaggaagcagagctacaggaatatgacttcatggacgtgatgctatccatacttgatgacgatattgagggtaaaaacctttcagattacgacgtcaatgccgacactatcaacaagtctacttgcctgaatctaatcctaggtgggagcgacacaacaatggttactttaacatgggccctcgctttactactaaataatccacacgtgttacaaaaggcccaagatgagttggatatccacgtaggcagcaagagacaagtggacgattcagatatgaagaacctcatatacctccaagctatagttaaggaaacaatgcgcctatacccagcaggtccactatcagtaccacacgaatcaactgaagactgcaccgtagctggctaccacgtccctgcagggacccgtcttattgtaaatacctggaagatccaacgtgacccacgggtatggtccaacccatcagaattcaaaccagagagatttctcacagacagtcacgtggacatagatgttagaggtcggaattttgaattgatcccttttgggtcgggcaggaggtcgtgcccgggtacctcatttgcactccaagtggtgcacctggtactggcccgtttgatacatgggttcgagtttaaaacaccgtcggaagcacccattgatatgacggagagcgtaggcctaagtaattttaaagccaccccacttgatgttctgctcaccccacgtctcccttctcagctttattatgtttcttag

SEQ ID NO: 100 - DNA, 1578 bp, Sanguinaria canadensis
atggattctactttggttttcattggcctctttgctttactactagtctaccccttactactaagaagatcagtattgaagtctacttcaaatactaataagactacttataaatcgaaaaaccaagcaccggaggcggccggggcgtggccgataatcggtaatcttcatcaactcgcgggtggaggaaactgtctccataaaacgttgggagccatggctgacaagcacggaccggctttcaccatccggatgggtctacataaagcacttgtggtgagtagttgggagctagcgaaagagtgtttcactaccaacgacgtggttttcatgtcccggccgcatcaagtagccattaaacacatgggttacagcaccgccatgtttggaatcgctccttatggcccatactatcgcgaaatgagaaagatagtgactcaagagcttctctctaaccgccgcctagagttgctaaaacatgtatgggcctctgaaatcaacaactccattaaacaactctacgagaaagtcgaaggcggaccagttttgatcgaaatgaagcgatggtttgcggatttaacgctaagaacgacggttaaggtgatttgtggacagcaacaatttggaggagatgatgatgatgatgaagctggaaggtttcaaacggcgctgagagacttctttaggttgttaggtcactttcgagtggcggatgtgatacctgttctagagtggctcgattttcagggatacaagaaagagatggagaataatggaagagtgcttgataatttaatgaataaatggttggaagaacataaaaggaagaggaagaacggtggcaccgaagaggacttcatgaacgtgatgatatccaaactgcttgatgatacaaagatgctttcctattacgacgccgatactatcaacaaatctacttgcctgacactaatcctgggtgggagtgacacaaccatggttagtttaacgtgggccctttctttactagtgaatcatccacatgtgttgaaaaaggcccaagaagagttggatgtccacgtaggcaaagaaagacaggtagacgattcagatctctggagcctcacataccttcaggctattatcaaggaaacattgcgactatacccacctggtccactctcagctccacgcgaatcaacggacaactgcaccatagctggctaccacgtccctgcaggaacccgtctaatagtgaatacctggaagattcaacgtgacccacgggtatggcccgacccattagagttcaagccagagagatttctcaccacccatgtggacgtggacgttaaaggtcagaatttcgaactcctaccattcgggtcgggtagaagagcatgcccaggtgcctcattcgcgcttcgggtgctgcgcctgtcactggctcgtttgatacatgggttcgactttaaaacaccattggacgactcacccattgatatggtggagagtggaggaataactaatgttaaagacaccccacttgaagtactagtcaccccacgcctcccttctagtctttatgtttgcaaatag

SEQ ID NO: 101 - DNA, 1599 bp, Sanguinaria canadensis
atggattttgatctttaccaattctcaaaacctactatcttcattggaggcctctttgctatacttctctactttgtactcaaaaaatctagtactcccaaatccaaatcaaaattagaacaaccacccgaaccggctggcgcgtggccgatcatcggtcatcttcctctcctcggaggacccgatctccctcacataacattaggaaaattggctgataaatatggaccagccttcaccatccgaatcggtgttcataaagcggtggttattaatagttgggaggtggcgaaagagtgtttcaccaccaacgacaaggcgttttcttcccgtccgcgtcaagtagccatgaaacacatgggttacgattacgccatgtttgggttcgccccttacggaaattactggcgtgaactccgtaaaattgtgaaccgagaggttctgtctcatagtcggatcgagtctttatatcacgtatggggtactgagatcaacacgtccgttaaagaactgtacgagttgtgggggaagaaaagcaccggcagcggcggtgcaccggtcttggtggaaatgaaacgatggttctccgacatgacactcaacatgtctgttatgatggttgcaggtaagagatacaactttagtggcaacaaagctgacgatgaagctgggaggtgccaagatgggctgaggaacttctttcggttagtcggtctgttcgtgccatccgacgcgttgccgtttttggcgtggttggacattggtgggtacgagaaagaaatgaagaaagtagcgaaagagcttgatgttttagtgcaggaatggttggaagaacacaaagagaagaggttggcattgacggccgcggggaagaaaggaagcgaaaacgatttcatggacgtgatgatgaatatacttgaagatcaaaaactatcagaattcgatgcagatactatcaacaaggctacttgtctgactttaatcctcggtggaaccgatacaaatatggttaacttagtgtgggccctgactttactggttaacaatcaagatgcgttgaagaaagctcatgatgagttggacttccacgtaggcaaagatagacaagttgaagaatcagatgtaaagaacctcgtgtacatccaggctataatgaaggaaacactgcgtctatactcgggcccactgtcgggcttacgcgaatctacggaggactgcaccgtagctggttactacgtcccagcagggacccgtttgattattaatgcagcgaagattcatcgtgacccacgggtatggtctgacccaacagctttcaaaccggatagattcctcacggaacagaaagaaatggatgttagaggtcaggatttcgaaatccttccattcggggcgggtagaagaatatgcccgggtgtgtcattcgcacttcaagtattgccattggcactggctcgattaatacatgggttcgactttaaaacacccacggatgcacccattgatatgacagaaagtccaggactaactaatgctaaatccaccccactcgaagttctagtctcaccccgcctcacttctaaactttatggttgttaa

SEQ ID NO: 102 - DNA, 1668 bp, Sanguinaria canadensis
atggattctattctaaaccagttcatctcaaaacctactatggttatttgcagcctctttgctttactatccctctactttctactgatcaaaaggtctaccactaaatcaaaattacaactgccacccgagccggcgggtgcgtggcctgtcatcggtcatctccatcagttgggtggacctaacttaccccacataacattagcagccatggctgataagtatggaccaatcttcaccatgaaaattggtacgtatcgagcactcgtagtgagtagtccggaggtagcgaaagagattttcaccacccacgataggatatgggcaacccgaccaaatcaagcagccatgaaacacttgggttacgactcggccatgtttgggttcgcaccttatggaccatactggcgtgaacttcgcaagttagtgaaccgagaacttctctctaatactcggctcgatttgctacatcatgtgtgggattctgagattaacacttccattaaagaactgtacgattcgttagcgaccaaaaacaatgcaaaaggccgtggtactggcggcgccggtagtactggtcctgttttggtggaaatgaaacggtggttcgcggatttgacgctaaacataactgttaggatggttgctgggaaacgatactttggtgctaataaaacttctagtactagtactgatcaatgtgataatgaaaaaggagatagtaaagcatggaagtgccaaagggagctgagaaacttctttaggttggtaggtctgtttgtagtgtcggacgcgttaccgtttcttgggtggttggatttgggtggtcacgagagagagatgaagaatactgcaagagagttggatgttttagttcaaggatggttggatgaacataagaggaagagatcattatccgtggctgaaggcggggagaagatcaacggcgaacaggacttcatggacatgatgctgtccacaatcgacgacgctaagttatctggttatttcgacgctgatactatcaacaagtctacttgtctgaatctaatcctgggtgggagtgacacaatgatggttaatctaatttggcccctcacgttactggtgaactatccagacgagttgaagaaggtttatgatgagctggacacccacgtaggcagagatagacaagtggacgaatcagatatcaagaatctcgtgcacctcaaggctgtaatcaaggaaacaatgcgtctatacacgggtcggatcacaggcctccgccaatcatcagaggattgtaccgtggcagggtaccacgtaccagcaggtacccgcctgattgtaaacacgtggaagattagccgagacccacggtactggtccgacccgttagagttcaagccagagagatttctcacgacccatgcggatatcgagcttacaggtcagaattttgaactaatcccgtttgggtcgggcagaagatcatgcccgggtgcctcatttgcaattcaattgctgcacctggcactggctcgtctggtacatgggttctggtttgaaaggccgtcggatgcacccattgatacatcagagtgtcctggactaactaattttaaagccaccccacttgaagttctggccaccccacgcctcccttctaaactctatgttggttaa

SEQ ID NO: 103 - DNA, 1617 bp, Sanguinaria canadensis
atggattttattctgaaccagttcatctcaaaacctactatggttcttggcaccctctttgcattactatccctctactttctactgatcaaaaggtctaccactaaatcaaaattacaactaccacccgaaccggctggtgcgttgcccatcatcggtcatctccatctcctcggtggaccaaacccgccccatataacattagcaaacatggctgagaagtacggaccgatcttcagtatcaagatgggtttaaaacgagcactcatagtgagtagttcggaagtaaccaaggagtgtttcactacccatgacttgaatttcgtctctcgaccacgtcatgcggctatgaaactcatgggttataatttcgctacgtttgggttcgcgccttatggaccttattggcgcgaacttcgtatgataattaaccgagaacttctctctcaaactcggatcttgtcgttagaacatgtatggggttctgagatcaatgaatccattaaggaactgtatgatttgttgacgagaaaaggtggtggtggtggtggtccggtggtggtggaaatgaagcgatggtttgcggatttgaccttaaatatagccgttaagatggtgtgtgggaagcgatacttcggtgttaattctcctagcactagtacgactcgtgatgttcaagaagatgatgaagctcggaggtgccaaaaggggatgagaaatttctttaggttgcttggtcagtttgtggtgtccgactcgataccgtttctggggtggttggatttgggtggttaccagagggagatgaagaataccgccagagagctcgacgatttaatgcagggatggctggaagaacataagaagaagagattggaaaggaagacggccgcaggggaacaagacttcatggacgtgatgctgaacatacttgaagatggaaagctatctcaatatttcgacactgatactatcaacaagtctacttgcctgagtctaatcctgggcgggagtgacacaacgatggttaatttagtgtgggccttcagtttactggtgaaacatcaagatgcgttgaagaaaactcgtgatgagttggacatccacgtaggcagagaaagacaagtggaggaatcagatatcaagaatctggtattcctccaggctgtagtcaaggaaacatttcgtctatacgctggcccaatctcaggagtacgggaagcagcggaggactgcaccatagcaggctaccacgtcccagcagggacccgtctacttataaatagctggaagattcaccgtgacccacgggtatggtccgacccattagagttccacccagaaagatatctcgaggcgaggcatgcggacattgacgttaaaggtcagaatttcgaactcgccccattcggaatgggtcgaagagtttgcccgggttccgcatttggactgcaagtattgcacctgacactggcccgtttgatacatgggttcgagtttaaaacaccgtcagacgcacccgtggatatgacggagagtgtaggaatgagtattattaaagccaccccacttgaagttctcgtcacaccacgcctcccttctgaactatacgtctaa

SEQ ID NO: 104 - DNA, 1602 bp, Sanguinaria canadensis
atggatatttctaatctttacgagttatactatttctccacacctactctgtttgtcggaggcctctttgttttattactcatctactctctattctcatccaggcctggaattaaatcaaaattacaacagccacctgaaccggccggtgcatggcctctcatcggtcatcttcctgtcttaagtggaccggaactaccccatgtcgcattgggaaagttggctgacaagtacggaccagtcttcaccattcgtatgggtgttcataaatcacttgttgttagtgattgggaggtaattaaagagtgtttcactacccacgacaaggtcttctcgtctcgtccttgtcaagttgctatgaaactcatgggtacggccatgtttggcttctccccttacggaaattattggcgtgaacttcgcaagatcatgaacagagaggttctatctcatggtcggatcgaatctctttaccatgtatggggttctgagatcaatacgtccgttaaagaactttacgatttgtgggcgaagaaaaacaatggtggtggtccaattttggtggaaatgaagcgatggttctccgatttaacgcttaacatgtcggttatgatggccgctggaaagcgatataattttggtgatgattcttctactactaatgatgaagcggcgaggtgccaacatgcgctgagagagttttttaggttggtgggtttgtttgtgccatcggacgccttaccgtatcttgggtggttggacataggtgggtaccaaaaacaaatgaagaaagtagcaagagaattggatgatttaatgcaggtatggttggatgaacataaaaagaagaggttagcagcgaaagccgaagggaagaagggaggcgaacaagacttcatggacgtgatgatgactatacttgaggacggaaagctatctgattattacgacgctgatactatcaacaaggctacttgcttgactctaatcctgggtgggaccgacacaaacatgcttagtttagtgtggaccctggctttactgatgaataatcgacaagccttaaagaaggttcatgaagagttggatatccacgtaggcagggaaagacaagtggaagaatcagatatcaagaacctcgtatacctccaggctgtaatcaaggaagaaatgcgtctatactcgggcccactttcaggtctacgcgaaacaacggaggactgcaccatagctgggtaccacatcccagcggggacccgtttgattataaatgcatcgaagctccaccgtgatcctaaggtatggtccgacccgttagagttcaagccagagagatttcttacggaaaacgtgggcgtggatgttagaggtcagaatttggaactccaaccattcggggcgggtagaagaatctgcccgggtgtctcatttgcacttcaagttttgcccctgacgttggcccgtttgatacatgggttcgagttgaatacacctggggatgcacccattgatatgacggagtctccaggactacaaaatgctaaactcaccccacttgaagttttaatcacaccccgactcccttctaaactatatgtttaa

SEQ ID NO: 105 - DNA, 1608 bp, Sanguinaria canadensis
atgattgttattggcgccttccttgctttagtggtactagtggtctactataatctactactaagaaggccagcattattgaaatttaaaaacatgaagcagcaggcaccagaagcggccagtgcgtggccaataattggtcatctccataatctcgcgggtggcataggcggaaacggcctactccacgaaaagttgggagcaatggctgacaagcacggaccggctttcatcattcgcttggggctgcataaagcactggtggttagtagttgggaggtagtgaaagagtgtttcactacaaacgacgttgccctcatttcccgcccgcatcaagtagcttctaaacacatgggttacggcatggccatgtttgcgttcgcctcgccttatggaccatactggcgcgaattgcgtaagattgtgaagcaagaacttctctctaatagccggcttgagttgctaaaacatgtatgggcgtccgagatcaacacctctattaaacaactctacgagaaagttaaagaaggtggtggtttgccggttttggttgaaatgaagggatggttcgcggatttaaccctaaaaatgacggtaaaggtgatttgtgggaagcgacactttcgagttgcgggtaatgtaggagatcatgttgatgctgatgacgatgatgaagtaattggtgggcgatttgaaaaggcgctgagagacttttttaggttgttaggagatattcgagtggtggacgtgttaccgtttcttcggtggttggattttggcgttggttataagaaagagatggagaataatggaagagtgctggatattttaatggaggaatggttgcaagaacataaaaggaagaggatgaacggcggcaccgaagaggacttcatgaacgtgatgatatccaaattacttaatgatacaaagctgctttcctattacgatgctgatactatcaacaaatctacttgcctgactttaatcctgggtgccagcgacacaactatggttactttaacgtgggccctctctttactagtgaatcatccacaagtgctaaaaagggcccaggacgagttggatgtccacgtaggcagggaaagacaggtggaagattcagatatccagaacctcacataccttcaggctataatcaaggaaacattgcgaatatgcccaccgggtccgattcaagctccacacgaagccaaggacgactgcaccgtagctggctaccacgtccctgcagggacccgtcttatagtaaatacctggaagatccaacgtgacccacgggtatggcccaacccgtcagagttcaagccagagagatttctcacgacccatgtgggcgtggacgttagaggtcataatttcgaactcatacctttcgggtcgggtagaagatcgtgcccagggacctcgttcgcactccaagttgtgcatctgacactggctcgtttcatacatggatttgagtttaaaacaccgtcggacgcacccattgatatgacggagagtggacgaataactaatgttaaagccaccccacttgaagttctagtcaccccacgcatcccgccgtctggtctttatgtttaa

SEQ ID NO: 106 - DNA, 1719 bp, Sanguinaria canadensis
atggatttgctgatcttctccagccagttgcaaggtactgtggggttattagctttactaaccttttcctattatgtatggattttaattataaagaggatcaaaacaaccaacaccttgaaggtcatgaataaagtggcggccgcggcggcaccggaagttgccggtgcatggcccatagtgggtcatcttcctcagctagttggccctcaacagctttacaggattcttggagacatggccgacgagtatggaccgatcttcatggtccggtttgggatgtacccaactctggttgtgagcagttgggagatgataaaggagtgcttcactaccaacgacaggttcctcgctagtcgtccctctagtgctgctgggaagtacctcacttacgacttcgctatgttcggcttctccttttatggtccctattggcgtgagatccgtaagatctctactctcgaactactctcccatcgacgccttgagttgtttaagaacgtccctttcactgagatcgacacctgcatcaaaagattgtaccaactttggcgggttaaaaataatgatcatccagctgctgctccggtaattaaggtcgacatgagccaattgttgagagatctaaccttaaatacaatattgaagttggtggtaggaaagaatttattcaacgagaaggatcatggtgaacaggaagagggtcgaaagctccacctccacaagacgatagttgaattctttaaactggcaggggtttcagttgcatcggatgctcttccgttcctagggtggctggatctggatggacagaagaaaaagatgaagaggatagccaaggaaatagacttaatcgctgaaagatggcttcaagagcatcaagagaagaaatcactatcaaacaagaagctgctggctgctggcggcggcaaagtagacggtcatgacgacttcatggacgtgttgttattcattcttgacgatgattcccagttcttcaatttcagtcgcgacactgtcattaaagccacctcttgggcaatgatcctaacagccgcggacaccacatccgtgtctatgacatgggctctgacgctactactcaccaatccccgtgtcttaagaaaggcccaagatgagctggatatgaaagtcggcagagacagacacgtggaagaacgagatatcgagaacctgatctacctccaagccatcgtcaaggaaacattgcgtttgtacccggctgctccacttggagtacctcacgaggctatccaagactgcaccgtagctgggtatcaggtaagagcaggcacacgtgtgttagtgaacctatggaagctgcatcgcgacccacgtgtgtggtcgaacccatccgaattcaggccggagaggtttctaatcgacgatattgacgagcaaggtggtggtggtggtggtggtggcggtgaatcaacagctaaggatttcagaggtcaacattttgagtacataccatttgggtcaggacgaaggatgtgtcccgggatcaacttcgcccttcagatcgttcacatgacactggcacgcctacttcatgcattcgagttgaggactactacgtccgcatcactaatggacatgaccgaagaatcaggcctcaccatgcccaagaaaaccccacttgtagtcctcctccaaccacgcctccctcttccactttatgatcaccatgagtga

SEQ ID NO: 107 - DNA, 1602 bp, Stylophorum diphyllum
atggagtttctctctctacaacaccaactaatttccatttttgctcttcttcttgcttccatattcctctacaatctcttgaagaatcatggaaggaaatccaagacctcaaaaccaccagcacctgaagcatcaggtggatggccaatcatgggtcatctcaatctcttcaatggaagcgaattaactcaccaagctctaggttccatggctgacaaatacggtccagctttcaatatccgattcggttctcatcaaacactcgttgtcagtagctcggagattgttaaagaatgtttcactacaaacgatcgattcttttcaaatcggccgggatcgttagcgattaaactcatgttctacaacgctgattcagttggttacgcaccgtacggtgcttattggagagatctcagaaaaatctcaaccttaaaactcctttcgaatcatcgactggaaaccctaaaacatttgagaacttctgaagttgagtcctgttttaaacaactttataatcaatggaagaacaacaaagttggcggcgaccatgattttgctctggtgaggatggataattggtttggagacttgacatttaacgttgtggcaagaattgtcgctggaaaaaagaattttgctggaggtgcgacgaatggcgacgtcggagctcagagatataaggaagctatggatgaagcgttccggttgatgacgatttttgcgttctcagatgtggttccgtctttgggatggttggataaattgagaggtttggttggagggatgaagcgttgtggtgcggaaattgattccattgttgcgggttgggtggatgaacatagattgaagagagcttctggaaagggaggaggtcatactgatcttgaacaagattttattgatgtttgcttggagattatggaacattctactttgcctggtgatgatcctgaaattgtcatcaaatctacttgtctggacatgattttgggtgggagtgacacaacaacggtgaccctaacatgggcactctccttactattgaacaatcctcacgtgttgaaaagggctagggaggaattggatacacatgtgggaaaggacagacaagtagacgactccgatatgtctaatcttgtgtacatccaggcgatcatcaaagagacgatgagattgtacccagcaggaccactgatcgagcgaaggacatcggaggattgtgaggtaggtgggttccatgtaccggcgggcacacgcttattggtgaacttatggaagatgcaacgagatgggagtgtgtataaggaggatccattagagtttagaccagagagattcttgactagcaatgctgatgttgatctaaagggacagaattatgaactgataccatttggtgcgggtaggaggatatgtcccggtgtgtcgtttgcggtgcagttaatgcatttggtgctggctcgtctcgttcatggctttgaaatgaagacggccggagatgcgaaggttgacatgacagaaagtgcaggactaattagccacaaggttacaccgctagaagtgctgctcaaaccatgccttgcgattcaacaagctttataa

SEQ ID NO: 108 - DNA, 1602 bp, Stylophorum diphyllum
atggattcttttcttctaatccagtggtttgcagcttccatggctgctctacttgcttttgtttttctctacaatcttgtctggagttcttcaagaactacaaagggtaagaatattagaaaggcacccatggcggccggtgcatggccgattcttggtcacctacatctgtttggatccggtgagctgcctcacaaaatgctctctaccatggctgagaagtacggtcccgctttcaccatgaagtttggtaagcacacaacactagttgtgagtgacacccgtatcgtaaaagaatgttttactacccacgataccctctttgctaaccgtccttcgactactgcatttgatctcatgacttatgctaatgactcggtagccttcacaccttatggtccttattggagggaacttaggaagatatccaccctcaagcttctctctaaccaccgcctccaatctatcaaggaaattcgagtatcagaggtgaacgtatgttttagggagctatatgaatcatgcaagagtaaaactgatgcaactccggttttggtggatatgaagaaatggttcgaagaggtctcgaacaacatagtcatgagggtaatagtggggagacagaattttggttctaagattgtgcaaggcgaagacgaggccgtcaattacaagaaagtaatggatgaactcttacgtctcgctagtttgtctatgttatccgatgtggcccctgtacttggctggttggatatgttccaaggaaacaagagcgccatgaaacgaaatgccaaaaaagtagacaccatacttgagggctggttggaggagcataggatgaagaagagcgcatcaggaatctcttctgctggtgagaatgaccaggacttcatggatgttatgttgtccatcattgaggagaccaagttgtctggccgcgatgcggataccgttattaaagctacttgcttggccatgatcatgggtggtacagacaccactgccgtgagtctaacatggattgtctctttactaatgaaccatcgccatgtactgaagaaggcccgagaagaattggacgccctcgttggtaaggatagacaagttgaagattcagatttgaagaacttggtatacatgaatgccatagtcaaagaaacgatgcgaatgtacccactgggtgctatgctcgagcgagaaaccaaggaggattgtgaggttggtgggttccaagtccaaggcggcacacgattactagtgaatgtgtggaagctacaacgagacccaaacgtttggaccgatccaacagaattcaaaccagagagatttctaaacgaaaatgcggatatagacgttgggggtcaacatttcgagctactaccatttggagctggtaggagggcgtgcccgggtgtgtcgttcgcactccaattcatgcatttggtactggctcgtctcatccatggatatgaattgggaactcagaatgatgcggacgttgacttaactgagagcacagaaggacatgttaaccacaaagcttcccctctcgatctcctccttaccccacgcctcaacaaccctaatctgtatgattattag

SEQ ID NO: 109 - DNA, 1707 bp, Stylophorum diphyllum
atgactataggggctctagctttactatctttcatctattttttacgggtttcagttattaagaggaccaaatacaccaacaccgcggtcaccgccaccaacaagttggaaaatgatgaagatgaggccaatcatagtaagcgagtggttgcaccacccgaagtcgccggtgcatggccaatattgggtcatcttcctcagctagtgggactaaagcagccactgttcagggtactaggagacatggccgacaagtatggacctatcttcattgtccgatttgggatgtaccctaccctagttgtgagcagttgggagatggcaaaggagtgcttcaccaccaacgacagggtcctcgctagtcgtccagctagtgcttctggcaagtacctcacctacaattatgccatgttcggcttcactaatggcccttattggcgtgagatccgtaagatctctatgctcgaactgctatcccatcgtcgcgtagagttgctcaagcacgtaccttccactgagattgacagctctatcaaacagttgtaccatctttgggtggaaaaccaaaaccaaaataagcaaggggatcatcaggtaaaggttgacatgagccaactactcagagatctgaccttgaatatagtattgaagttggtggtaggaaagcgtcttttcaacaacaacgacatggatcatgaacaggatgaagcagctcgtaagctccagaagacaatggttgaactcattaaagtggcaggggcttcagttgcatcggatgcccttccattccttggttggttggatgtagatggactaaagagaaccatgaagaggatagccaaggaaatagatgtaatcgctgaaagatggcttcaagagcatcgacaaaaaaaactaacatcaaacgacaagggtggcagcaacaacattcaaggtggcggtggcgataacgacttcatggacgtgatgctatccatccttgacgatgattccaatttcttcatcaattacaaccgcgatactgtcattaaagccacctctctgacaatgatattagcaggttcggacaccacaactctgtccttgacatgggctctaacgctattagccaccaaccccggtgccttgagaaaggctcaagatgaacttgatactaaggtgggcagggatagacaagtagatgagcgagacatcaagaacctggtctacctccaagccattgtcaaggaaacactacggatgtacccagctgctccactagcaataccccacgaggctacccaagattgtattgttggcgggtatcacgtaacagcaggcacacgtgtgtgggtgaatctgtggaagttgcaacgggatccacacgcgtggccaaacccatcggagttcaggccagagaggtttctagccgttgagaacgattgcaagcaacagggtacttgtgatggtgaagcagcaaacatggatttcagaggtcaacactttgagtacatgccttttgggtcaggaagacggatgtgtccaggaatcaactttgcgatccagatcattcacatgacactggcacggctacttcattcattcgagttgcgggtgccagaagaagaagtaatcgacatggctgaagattcaggtctaaccatatccaaagtaacaccacttgaactcctacttaccccacgcctccctcttccactttatatatga

SEQ ID NO: 110 - DNA, 1584 bp, Stylophorum diphyllum
atggctgcccttcttcccttagctttcctctacaatatctttttggcttcatcttcgaaagctactagcaagagaacaataagtactaagaaaccgcccatggtagccggtgcatggccaattcttggtcatctccatctgtttaaagagggtgagttgcctcaccaaatgcttaaatccatggctgacaagtatggtccagccttcctcatgaagttcggtcaacaccaatccctagttgtgagtgactaccgcatcgtaaaagaatgctttactactaatgataccctcttctgcaaccgtccatccactacagctttcgatgtcatgacttacgctaatgaatcggtagctttcacagaatacagtccttactggcgcgagcttagaaagatatccactctcaagcttctctctaacaaccgtctccaggccatcaagaacctccgagaagaggaggtggatgtgagcttcaaggggttgtatgattcatggaagaataagaacaacaagagtactgctggcagtgttggtgatgaacgagctccggttttggtcgacatgaagaaatggtttgaagaagtgtcaaacaacgtggtgattagggtaatcgtgggcaaatgtaattttgggactaagatcgtgcaaggtgagaaggagggtgtggagtacaagacaatcatggatgagcttttacgacttgctagtttgtctttgttatccgatttcgcccctatacttggtttgttggatttcttccaaggccatgtccgtaccatgaaacgaaatggcaagaaactagacgtgttacttcagaggtggttggaggagcataagaggaagaagagcacaccagaggatgagcaagacttcatggatgttatgctgtcgattattgaggagagcaagctgtctggctatgacgctgataccgtcattaaagctacttgtctggccatgatcatgggtggaacagacacatccgcagtgagtctaacatggatcgtctctttactgatgaacaatcgtcaagcactaaaaaaggctcgagaagaattggacgcgcaggtggggaaggatagacaagttgaagattcagatttaaagaacttggtttacttgaatgccatcgttaaggaaacaatgcgattatacccactaggtactcttcttgaacgcgaaactaaggaggactgtgaagttggtgggtttcacctcgaaggtggtactcgtttactagtgaacgtatggatggtacagcgagacccagacgtgtggactgatccgacaaagttcataccagagaggtttcttacggagaaggcagacatagatgttgggggtgggaattttgaacttataccattcggagccggtagaagggtgtgccccggagtgtcctttgcacttcaattcctaaatttggtactagctcgtctcattcatggatatgaattgggaactccagaagatgcggatgtggatctaactgagagcccagaaggacatgtcaaccacaaagcatcccctctcgagcttctcctcaccccacgcctcagtaaccctaagctctatgattattag

SEQ ID NO: 111 - DNA, 1644 bp, Stylophorum diphyllum
atggattctgatcatcaacttctcagttaccagttctctgcaagtaatatgtttatcagcctctttgcttttgttctctactatctactagtatggaggccaacaaaatctaatcttaagatgaaaaccatatcatctgaagacaagcaagcacccgaactcgccggttcatggccagttatcggtcatcttcatctccttcatggacctaacccactccatgtagctttgggagccatggcggacaagtacggaccagctttcaccgttcgagttggtgtccatcggacacttgttgtgagtagttgggaggtagcgaaagaatgtttcactaccaatgacaaggtctttgtatctcgtccacgtcaagcagcaggaaaacacatgggttacaacaacgccatgttgcgattcgcctccgatacaccatactggacccaaatccgtaaaatgttgaaacgagacctcctctctaacaaccggattgagttgctaaaccatgcatggcattccgagattaacacatccattaaagaactgtacgagatgaattggtcatcaggcgaaggacgtcgtggcggcattagaccgccggtctcggtggacatgaagcaatggcttggtgatttaaccctaaacatgtctgttaaaatgattgctgggaagagatgttttggcagtggtgtttctgcttgtgatgaaggagaagctagaaggtgtcaaaaggggttgaaagacttcgttaggttgatgggtcagattgtggtgtcggatgcaataccatttcttggatggttggatttggatggctacgagggggaaatgaagcgagccggaaaagagctcgaccgtttactaggaggatggttggaagagcataaaatgaagagatcaccaggtgatgaagcttcagcccagaaggactggatggacttgatgctgtccgtacttggggatggaaagcttgacggctattacgacgctgatacgatcaacaaagctacttgtctggctctattgcagggtggtagcatctggacgatgcttactttattatgggcatttgccttactagtgaatcatccacatgtgatgaaaaaggcccatgatgagctggacaaccatgtaggcagagaaagacaagttgaggaatcagacatcaagaacctcacttaccttcaagccatagtcaaggaagcaatgcgtctttactcggtgtcgatgcgactactcgaatccaccgcagactgcactgtttctggctacgatgtcccagctgggactcgtctaatcgtaaatacttggaagattcagcgtgaccctcgggtatggtccgacccatctgaattccatccagagagattcctcacacaccgccatagggacatggacttgtatggtcagaattttgaaatcacaccttttgggtcgggcagaagatcatgcccaggttcctcattgggtcttcaaatggtgcaactgacaatagctcgtttgctacatgggtttgagtttaaaacaccttcggacgcccccattgatatgactgagagtgttggggtagaaaatatggttaaagcaacaccaattgaagttctgctcaccccgcgcctcctcgatgaggtttatgctttctataattag

SEQ ID NO: 112 - DNA, 1687 bp, Stylophorum diphyllum
cttttgccagttccaaggtattgtaggaatcttattagctttcctaaccttcttatattatctatggcgggcttcaattacaggattaaggactaaacccaaacacaacgactttaaagtcactaaggcagcacctgaagctgatggtgcatggcccatagttggtcattttgctcagttcataggccctcggccacttttcaggattcttggagatatggccgacaagtacggttcgatcttcatggtccgatttgggatgtacccaaccttggttgtgagcagttgggagatggcaaaggagtgcttcactaccaacgacaggttccttgctagtcgtccagctagcgctgctggcaagtaccttacctacgactttgctatgttaagtttctccttttatggcccttattggcgtgagatccgtaagatctctatgctcgaactgctatcccatcgtcgcgtagagttgctcaagcacgtaccttccactgagattgacagctctatcaaacagttgtaccatctttgggtggaaaaccaaaaccaaaataagcaaggggatcatcaggtaaaggttgacatgagccaactactcagagatctgaccttgaatatagtattgaagttggtggtaggaaagcgtcttttcaacaacaacgacatggatcatgaacaggatgaagcagctcgtaagctccagaagacaatggttgaactcattaaagtggcaggggcttcagttgcatcggatgcccttccattccttggttggttggatgtagatggactaaagagaaccatgaagaggatagccaaggaaatagatgtaatcgctgaaagatggcttcaagagcatcgacaaaaaaaactaacatcaaacgacaagggtggcagcaacaacattcaaggtggcggtggcgataacgacttcatggacgtgatgctatccatccttgacgatgattccaatttcttcatcaattacaaccgcgatactgtcattaaagccacctctctgacaatgatattagcaggttcggacaccacaactctgtccttgacatgggctctaacgctattagccacctawcccctgtgtgccttgagaaaggctcaagatgaacttgatactaaggtgggcagggatagacaagtagatgagcgagacatcaagaacctggtctacctccaagccattgtcaaggaaacactacggatgtacccagctgctccactagcaataccccacgaggctacccaagattgtattgttggcgggtatcacgtaacagcaggcacacgtgtgtgggtgaatctgtggaagttgcaacgggatccacacgcgtggccaaacccatcggagttcaggccagagaggtttctagccgttgagaacgattgcaagcaacagggtacttgtgatggtgaagcagcaaacatggatttcagaggtcaacactttgagtacatgccttttgggtcaggaagacggatgtgtccaggaatcaactttgcgatccagatcattcacatgacactggcacggctacttcattcattcgagttgcgggtgccagaagaagaagtaatcgacatggctgaagattcaggtctaaccatatccaaagtaacaccacttgaactcctacttaccccacgcctccctcttccactttatatatga

SEQ ID NO: 113 - DNA, 1569 bp, Tinospora cordifolia
atggatttaccacaaccgaccatatcaaccacacttctagcttttttcagcatcttattattcatcatatgctatcgtctcttgagcactaaatctgacaagagatcatcatcttccagaaacaaacctcttgacgctcctggagcatggcccgtcatcggtcacctacaccttctaaacggcgtcatacaacacgaaattctgggaaccatggcggacaaatacggaccggcgttcaccatctggctcggcacgcgtccggcactagtggtaagcaactgggaagtggctaaggagtgcttcaccacctgcgataaggccttagcaagccgtcccccaagcttagctttgaagatcatgggctacaacgacgcgttattcgcgttcgctccttacgggcaatactggcgtgagttgcgcaaaatagtgatgattgagcttctttctagtcggcagcttgattcgctgaagcatgtttgggattctgaaattgattcatgcatcgaagatttgtatgaaaaatgtaagggtcatcgtgaaacagtactggtgaatatgaagcagtggtttgcggatttgatgatgaacgtagtggtgagaatggtggttgggaagctgaattttgggaaaacgaaagaaggtgatgatgaggtcgcgaaggcgcaccaagggcagttgaaggcgatgagagagttcttcaagtgggtggatgtgtttatgatagaagacgcgtttccgattctgacttggttggatcctcaagggtatcaaagaaaaatgaagaatatagcgaaagatctggactcgctggttcaggggtggttagatgagcataagttgaagcaaaaaactggcgataatgggaagaaagacttcatggatatcatgctgtcggcggtcaaagatgctagtatatctgacagagacgatgagacaatctgcaaggcgacgtgcttgaatataattcttggggcgagtgataccacaacggtgaccctcacatggaccctttctttgttactaaataatcgacatgtcttgaggaaggcccaagaagaattacaagcacaagttggcaaacacagatgcgtggaagaatcagacgtcaagaaccttgtttatctacatgccatcatcaaagaagtgctaagactttacccagctgttccgcttttaggcccacgagagagtgtagccgatactgtggtggcaggctaccatatacccgcaggcacacggctaatcgtgaacctttggaagattcatcgagacccgcttaactggcctgacccgcttgagtttcgacccgagagattccttacgacccacaaagacacagatgtgtggggtcagaattttgagttgactccttttggatccggaagaaggatatgcccaggtatttcgtttgcgcttcaagtaattcctctcacactggctcgattgctccatgggtttgagctcaccacaccaggtagtgcaccggtggacatgactgaaagcactgggctcaccaacttgaaagccacacctttagatgttttcatcagtccacggcttgttctttga

SEQ ID NO: 114 - DNA, 1581 bp, Tinospora cordifolia
atggagtccattcccacagcaattaatgtgcttcttgccttcgtctccatctactatcttctgaagttccggaaaaagatcatcacaacgactagagatatcaagaagatcaaagcaccagaactaaagggtgcatggccgatcataggtcaccttcatctattcagatccgatgatcttctgcatcgaaagctcggtgccatggccgacgagttggggccagcgtttatgatccggctaggtatgcgccctgctcttgtagtgagtaactggcaaacagccaaggagtgctttactaccaaagacaggatcttcgcaacccgtcccgattcggttgctgcgaagcacatgggctacgaaaatttaatattgggcttcactcgttacggaccttactggcgtgaggttcgcaagattgtcacgctcgagcttctctccagccatcggctacacctgctcaggcatgtcaggatatcagagattgacatgtccattaagaaactccatcagctttgtaccagtaacgacaacaaatattcatcagttgtggtcgacctgaatcaatggtttaaagctttaactcttaatataatcgtgagaataatagcgggcaagcggtattacggtggagacctcgaggacgatgaggagtcgcggcggtggaagaaagctcttaacgaatttatgcatctctttggaatattttcggtgtcggatgcgattcctcagttgcagggtatggacgtgcagggacatgagcgtgtcatgaagaggactggtaaggatattgatgtgattctgagcaaatggttggaagagcacagaaggaagaagatcagggttaacagggaaggagctgagaaagatttcatagatataatgcttgacctaatcaaagaaaacgtcaatatctccggtcatgatgctgataacgtcgttaaagccacttgtttggcccttgtatcagcaggaagtgatactacaatgatcactctaacatgggctgtgtcgttacttctgaataatcatcgagtcttggagaaagctcaagccgagttggataatcaaattggaataaacagagtacatgtagaagaagaggacatcaagaatctaccataccttcaagcaattgtgaaggagactcttcgcttatatcctgctgctccattttcattgccacatgaggccatggaggaatgtactgttgcaggcttccatgttccgaaagggacacgcttaatcacaaatatctggaagctgcaacgagatccccaagtctgggaggatcctttggagttcaggccagagagattcctcacaagtgatcgtcgtcatgtggattttagagggcaacattttgaattaataccatttggatcaggaagaaggatgtgccctggcatttcatttgccattggtgtcttgcacctgacgcttgcgcgtttacttcatgaattccaccttggaactccgaccaacgcacccatagacatgaatgaaaatccaggaattaccctcgagaaagcagatcctcttcatccactcgtctctccaagacttacttccatcaactactga

SEQ ID NO: 115 - DNA, 1617 bp, Tinospora cordifolia
atggattcccagttaacttcgtttcaatccaagcccagtgcatatctaattgctgcacttcttgccttagtttctgcatactatctcatcatcaagaagaaaagcagagcaacttaccaagataactacggcaagattagggcaccggaaccaaagggtgcgtggccaatcatcggtcaccttctcctgttcaaacccaacgatgtgctgtatcaaaagcttagctcgctcgcagacgagttaggaccagcgttcatgatacggctgggcatgcgctcagctctcgtaataagtaactgggaaatagccaaagaatgcttcaccaccaacgacaggatcttcgcgacccgtccaaagttgatggcctcaaagcacatgggctacggtggcgcagaagtcggcgtcgcgccctacggtccctactggcgtgaggttcgcaaaatcatcacggtagagcttgtctccaaccaccggctcaacttgctcaaggacgtcaggatatcggagatcgatatgtccttaaaagagctctatgatctttgtatgaagaagaagaagaacggcagtggagaagaatcatcgcgggttgaattggacctgtaccaatggttcaaggacatgtcgctcaacatattggtcaagctcatcgcgggcaagcggtattacggggtggccgctgccgccaacgaagatgaggaatcgcggcggtggaagaaagcaacggaggaatcggttttcctgtttggacaatttgtggtgggggatgcgattcctttgttggagggtgtggatgtgcaagggcttgagcgtgccatgaagaagactggtaaggaaattgatgcagttttgagtaaatgggtggaagagcatagaatgaagaagcagcagcttaatggggcaagagatgagcaagatttcatagatgtgatgcttaacataataaaggatggcaagatctctgatcatgatgctgatactatcgttaaagccacttgtatgtctcttgtacaagccggaagtgacaccacaatgcttaccctgacttgggctgtgtgcttgctactaaacaattgcaatgttttagagaaagctcaagcagagttggatgatcaaattggaagaagcaaaggacgtattgtagaggaagatgacatcaagaaactgccttatctccaagcaattgtgaaggagacttggcgcttgtaccctcctgctccacttgctgtaccacgtgaagccatggaggactgtactgtagctggcttccatgttccaaagggtacacgcttaatgacaaacatatggaaactgcatcgagatcccaaagtgtgggacgattctttaaagtttaggccagaaagattcctctccagtgaacatgcacatgtggattttagagggcaacagcatgagtttatgccctttggatccgggagaaggatgtgccttggaatgccattagctattggtgtggtacaccttacacttgcccgtttacttcatgaattcgagcttgcaactccgtcaaatgcaccagtagatatgagtgaaaaagctggtcttactttggttaaagcgacgcctctaaatgttcttatcgccccacgcctttgctaa

SEQ ID NO: 116 - DNA, 1596 bp, Tinospora cordifolia
atggattcaataatactccagagtaaccttcttaccactgttataataataacatcctttggcctctttgtcctttccttttactatgttctctggaaggcaattagaactggcaacaagagaaattgcagcaaccctaaggctcctgaagctgctggaggatggcccattctcggtcatcttcatttattcagaggccaaggcctattactgcacaaaatttttggagccatggccgaaaaacacggaccagcattcaccattcggctcggaatgcgtccggcactagttgtgagcaactgggaagtggctaaggagtgtttcaccgcaaatgatcgggcccttgcgagccgccctacgagcttagccttgaagattatgggctacaacaacagcttgttcgcgttcgctccatacgggcaatattggcgtgagttgcgcaagatagtgatgcatcagcttctctctagccgtaggctcgagttactcaagaacgtttggctttctgaaattgatatatggatcaaaggcttgtacgagaattccttggttaataaagtggtggatatgaagcagtggtttggggaattgatgatgaacatagtggtgagattggtagcaggaaagcgaagttttgggaaaatcagagaaggcgatagtgaggaagcgaaggcgcatcagcggcaaattaaggcactgcgagatttcttcaggttggtggaggtttttatgatagaagatgcgtttccttttctaacttggttggatcctcgagggtatcaaaaagaaatgaagaatatagcaaaagaactggattatcttcttgaggagtggttagaagagcataaactgaagcaacaagctgcatgtgatgatcagagcaaggacttcatggatgttatgctgtcggaggtcaaggattctactatcactgaaagagatgcaaacacaatctgcaaagcgacttgcctgaatgtaattttaggtgcgagtgataccacaactctgactctcacatgggccctttccctactactgaacaacagacacgtattgaagaaggcccaggaagaattaaatgcccaagttggcaaggataaacaagtggaagaatcagacatgaagaaccttgtgtacctacatgccataatcaaagaagttctaagactctacccagctgctcctttgtcagtggcacatgagtctttagaagacaccgtggtggctggttaccatgtctccaagggcacacaggtcatattcaacctttggaaaattcaacgtgatccatctgtatggtccaacccgctagaattccaacctgagagatttctcaccacccacaaacatgtagacatttggggtcagaattttgaattgataccgttcgggtcgggaagacggatgtgcccaggcgttcctttcgctcttcaagtggtttccttaacgttggctcgattacttcatgggttcgagctcacaacaccaggtggcgcagctgttgacatgaccgagactcctgggctcactaatatgaaagcaaccccggtagaggttttccttagacctgacctccctcaccagctctatgcttga

SEQ ID NO: 117 - DNA, 1575 bp, Thalictrum flavum
atgccaagccaaaccatacaaattataatggatttctttcatcaatgtgttgcaactatattattttgtgtcttagcttcaccttttttcttttattatctactcccatggtggaaaaatgctaatgatcatgatcttgccaagagcagaggaaagcctgttcctgaagtagatggtgcatggcctattatcggtcatatgcatatgctgcaaccatcagatagcttttactcatctttggcggaaaagtatggaccaattttcacacttcgaattggtttatgcaaaacaattgtgattaatagttgggagctagctaaggaatgttgtaccactcatgatagagtgtttgcaagctcgcctgaagctacagcggcaaagatattgggatatgattatgctatgtttggacgaaacccttatgggccttactggcgtgaaatgcgcaaaataattataactgaacttgtgtcaaatcggagactggagctactaaaacatattagagtaacggagatcagtacatccatacaagaattgtaccagttgtgggaagcaaggagtagtaagaatgtaaaagaaagagttgtggtggatatgcaaaaatggtttggtgacttgatgctaaatattggtgtcgagatggttgctggaaagagatattttggtgcaagttcgaatgaagataaagaggaagcaagacagttgcataagacatttaaagatttctcgaacctatttggagtgcctgtgctatctgatgcaattccatttcttaggtggttagactataaaggacatattaaagccatgaagagatgtgcaaaacaagtagattgtatcttgcatagatggttggaggaacataaacaaaacaagacaacaattgctggggatttcatggatattttgttgtcagtacttcaggataaagagatctttggtagggatgcagacaccgtaatcaaggctacatgtctgaatatgatgctgggtgttgtagaaaccaataaggtcactgtaacaatggcactcatctcattgttgaacaatcgtcgcattttgaagaaggcacaagaagaaatagacattcatgttgggagcgataaacaagttgaagaatcagatatagagaaacttgtatatctccaagccattgtcaaggaaacgttgcgcttgtactcacctggtctaggaacacgtgagccctcagaggactgcaccatatcaggtttccatgttccaaaaggcacagaggtaatggtaaatgttcagcagattcatcgagatccaagcatttggtctaaccctcttgaatttcaaccagagagattcctcaccacacaagcaaatatagactttgggggtcaacatcatgaatacattcctttcggggcaggccgtagattatgccctgcaatctcattcgcagttctggtggtgcacttgacactagcacgtttgctgcaagggtttgattttgcaacaccaaaggatgcacctgtggaaatgaatgagagtgtggaaactctggaagttttaatcaccccacgactccctttgcatatgtattaa

SEQ ID NO: 118 - DNA, 1605 bp, Xanthoriza simplicissima
atgcacaatcccataccaaaccaatggctaccaagttcaactcttctgacgcctatcattgttagtttcctcgttatcgttctcttctatatctataagaagagaagtagtaacacgatcaggaccaagaaggcgcctgaagtagtaggagcatggcctgtaattggacatctaaatttatttagttgtcctaaaccgggtcatatagtgctgggcgaactagctgatcaatatggccccgcatttactatccattttggtatgcatccaacactggtggttagtagttcggagctggtgagggactgtttcactacgaatgacaaattattttccagccgtctagttaacaaagccatcaagtacatgttctacgatcaggacactatttcattcgcaccttatgggccttattggcgtgagcttcgtaagatgattgctcttaatcttttaaataatgaacgcatcaaaatgctccagcagcaaaggatttcagagatggatgcttgtttaaaaaagctgtacgatttatcagcaaaaagaaaagacgagaacgcaggggtattggtggatatgagtaaatggtttgccgaaatttcctttaatgtggttaccagaattgttgctggaaaacatatttttgggcctaaagttgaaagatacaagaatgtgatggaagaggcacgccgtcttatggacgtcatggttttctccgacatggtaccttatttaggatggttggatagattgcgaggagtggacagtgctataaagcggacagccaaagaattggactctgttcttgagagctgggtggaggaacatcgtcgaaagagcgtgtcaatctcagctggaacgggaggcattttcaacataaaagaagaggaggaattggattttatagacattatgttgtcgattatagccaagaacaatttaccaggtgacgatcctgatactttaatcaaggctattgtccaggaaacgtaccttgctgcgtgggacaacacaacggtaactcttacatgggtcttgtgtttgttattaaacaataagcaagttctgaaaagagctcaaaatgaattagacgctcaagttgggaaggagaggcaagtagaagattcagacattaataatcttccctatgtacaagccattgttaaagaatcattgagattatatccaccaggaccgataattgaacgggcgactactgaggattgtaacgttggtggcttccgcgtcccggcaggtacacggctttgggtaaacttatggaagttacaacgagacccaaaagtatggcctaatgatccgctagaatttcgaccagaaagatttctcaatgacaatgcagacattgatttgaggggtcagaattctgaattaataccatttggatcagggaggcgcatgtgtcccggtgtctcattttctcttcaagtcatacatctggtgattgctcgaataattcagggatttgagttaaaggccccaacagatgcagatatcgacatgtctacaacgctaggaatgataagctggaaagcaacaccacttgaagtactcatgaatccacgcttcccacccgtgttttacaagtga

SEQ ID NO: 119 - DNA, 1653 bp, Xanthoriza simplicissima
atgtctacattacaaattagcattttaacagttaaatccccgtattcacaaatgcattattatccccttcttcaccaatggctaccagcttcaatggcgctagtcagtttgctcgttatcattctcttctctatcttcaagaagagaagtagtaagatgatcaaggccaagaaggcgcctgaagtagcaggtgcatggcctctaatcggacatctcaatctatttagtggtcctaagctacttcatttagtacttggagaactcaccgatcaatatggaccggcctttatgatccatcttggtatgtatccaactttggtggtgagtaattgggagcttctaaaggactgtttcactacaaatgacatattcttctcaaatcgtccagttaacaaagcgatcaagcacatgttctacaataaagagtctattggattcacaccttatggatcctattggcgtgagcttcgtaagatgactactctcaaacttctatcaaaccaccgccttgatctgctcaagcccttgagaatttcagagatggacgcttgttttagaaacctttatgagttgtggacgaaagataaagacgggaatgcatggctgttggtggatatgagtaaatggtttggcgagatctcgtttaatgtggttgcaagaattgtagctggaaaaaagaattttgggtccaaaggtgataggtataagacagttatggaagaggtggtccgtcttatgggtctcagagctttgtcggacgcggtaccatatttaggatggttggatcagttgcgaggactggacagtgctatgaagcgggcggccaaggaattggattctgtgcttgagagctgggtggaggaacaccgcctaaagagggtgtcagtttcagctggaactggaagcactgtaaagacagcaaaagaggaggaggaggaggaggacttcatagacattacattgtcgattttggcggagaaccaattaccaggtgatgatcctgataccggcatcaagtctcttatcctggacatgatcctgggtgggagcgacacttcaacggtgacactaatatgggcaatgtgtctgctattaaacaatgtgcatgtgttgaaaagggctcaatatgaattggacgcacagattgggaaggaaagacaagtagaggattcagacataaagaatctgccctacatccaagccattattaaagaaacaatgagattatacccagcaggaccgattatcgaacgccaggctaatgaggactgcgacgtgggtggcttccatgtcccagcaggtacacggctatgggtaaacttatggaagttacaacgagacccaaatgtatggaaggacgacgcattagagtttcgacctgaaagatttctcactgatcatgcagacattgatttgaagggtcagcatctggaattaattccatttggatcaggtaggcgtatatgtcctggtatctcatttgctcttcaagtcatgcatttggcacttgctcgaattattcatggatttgagttgaagaccccaaatgattcaaatatcgacatgtctggaactcctggacttttatgctgcaaagcaacaccactccaagtactcctgactccacgttttaaccccatgttttataagtga

SEQ ID NO: 120 - DNA, 1563 bp, Xanthoriza simplicissima
atggattcacttcgacattgtttaggaggtattcttgccttactaatctttcttggttatctgcaatggaagagaggaacaagtaacaagtgcatagaagctcctcaaccggatggggcatggcctatcataggccatttgcctaggttgatgaaaccccaaataatgcatagaacgttgagcaccatggctgataaacacggcccagcgtttactctccggcttggcgtacataaaacattggtggtgagtagttgggaggtagccaaggagtgtttcactaccaacgacagagtcttcgctacccgcccaacctctatcgccgtggagatattgggctacaactacgccttatttgcctttggtccttatggctcatattggcgtgaagcccgcaagatagcaatacttgagcttctctcaaaccataggctcgagttgctgaaacatgttcggatctctgaggtgagcacatctataagagaattgtaccaagtgtggaaagaaaattgtgatatagcaaatggatctgctttggtggatatgaaaccatggtttggtgacttgacactaaacgtggttgttagaatggttgctggaaaacggtacatgggtggcagtgttaaatcggatgatgttgagggaaggcgatttcagaaggccactaaagatctctttgatttatttggactgtttatattgtcagacgcgcttccatttatgggttggttagacctccatggccataagaaagccatgaaaaaaactgccaaggagctggactccattatgcagagatggttggaagaacatcgacaaagtttattggatgatggaacaaaggaggagaagaaggacttcatgtatgtaatgttatctatccttgaggataaaaagctatttcaatatgatgccgacatcgttaacaaagctatttgcatgaatatgattatggcaggtactgatactcaaatgatcactctaacatgggtcctttctttactactcaacaatcgacacattttaaagaaggcccaagatgaaatcgactccagtgttggaaaagatagacaagtcgaggagtcagacatagtgaaactagtgtacctccaagcaattgtgaaggaagcattgcgtctctacccacccgctcctctatccgcacaacatgaggccatggaggactgcactgtggctggctactatgtcccagctggcacacgcctaataacgaacatacggaagattcaacgagatccacgcgtatggtctgacccttttgagttccatccagagagatttctcacaaaccaagcaaatgtggactttagaggtcaatcttttgagttcattccttttggatctggaagacgaatgtgcccaggcatttcatttgcgcttcaagtggtgcatttgacattagcacgtatcctacaaggttttgattttgaaacaccaatgaatgcttctgtggacatgactgaggcaccaggtctgacaaatgttaaatcaacccctcttcaagttctaatcaccccccgtctccacccaaacctatattaa

SEQ ID NO: 121 - DNA, 1572 bp, Xanthoriza simplicissima
atggatttacttaacccatattttgcaactatctttggtggtttctttgcgttactaatttttctttttatcatttcacagaagagaagtaggattcccaagatcagagcagctccagaaccagttggggcatggcctatcgtaggacacttgcctatgttacttggacccagattaccccattttgtgttgggagaccttggagagaagtacggatcagcatttactctccggcttggcatacataaaacattagtggtgagtagttgggaggttgccaaggagtgttttactacaaatgaccaagtattcgccacccgccctagcttcatggcagcgaagataatgggctataattatgctctatttggcttagcaccttacgggtcatattggcgtgaactccgtaaaatatctattattgagcttctttcaagtcataggcttgaattgctgaagcatgttcgagtctctgaggttagtacatcaatgaaagaattgtacgaggtgtgggcagaaaactgtagtaatggaaacggatctgttttggtggagatgcagcgatggtttggtgacttgacactaaatataagtgttaggatggttgctggtaagcgatactttggtactagtgctagtttggatgacgacgaggcaaggcgaatatcaaaggccacaaaagatttcttccgtttgacagggatgtttgtggtgtcggactcggttcctttcctttggtggctagattttcagggccacgagaaagccatgaagagaaccgccaaggaaatggacgatatatttgggggatggttggaggatcatcgacgaaataaacttgctggtggaacaaaggtgcagcaagacttcatggatgtgatgttgtctatccttgaggacgaaaagttctttggttataatgccgatgttgtcacaaaggctacttgcctgaatatgttgttgggtgggacggataccacaatggtcaccttgacatgggccctctcattactactgaacaaccgtcatattttgaagaaggcccaaactgaaattaacactcatgttggaaaagatacacaagttgatgaatcagatatagtgaaacttgtgtacctccaagcaattgtcaaggaaacattgcgtctctacccagctgctccactatccacaccacacgaggccactaaggactgcaccatcgctggctaccacgtcactgcagggacgcgcttgataacaaatatatggaagattcaacgagacccacgcgtatggtccaaccctagtgagtttcaaccagaaaggtttctcactgatcaagcaaatgtggacgttaggggccaacattttgaattcattccttttgggtccggtagacgatcctgcccaggaatctcgcttgggctacttgtggtgcagttggcattagcacgtttgctacaaggctttgatttcgaaacaccatcggatgcattggtggacatgactgagagcgctggattaactaatctcaaagcaacacctcttcatgtcctaattacaccgcgtctccattcaagcctgtattaa

SEQ ID NO: 122 - DNA, 1593 bp, Xanthoriza simplicissima
atggactcagttcaccaaggccaatacctaccaactccgatggtcagtgtctttgtgttttttatcagtctttactttctaattgtgtggaagacaaggtctagttccaagactaacacttgcaacgaagtacccgaagcgcctggggcgtggcctattatcgggcacctccatttgttaggtgggagtgaattaccccacaagacattaggagccatggctgataagtacggcccaatctttaagattcgtattggtgtgcatcaagcattggtggtgagtagttcggatattgtaaaggagtgtttcactactaatgataaggtttttgcttctcgtcctacctcgacagcatcaaagatcctgggctatgattatgtcatgtttggtttctctccttacggaccgtattggattgaactacgcaaaataattatgtcggaacttctctcaaaccgcaggctggaactactaaaacatgttagggactctgaaatcgatatatctatccaagaactatacaaggtgtggaagaatcatgataagtcaaaaggtccaatcttagtagacatgaagcaatggtttggagacttggcactcaatgtgattctaaggatgattgccggaaagagatactctggttcaatcttttcttctgatgagacagaagcaaggagatgtcaaaagggagcgagagatttctttaggctgttggggctattcatcattgaagatgcacttccgtatctaagttggttcgacttacaaggttacaagaaagagatgaagaacacggcaaaagaacttgattctgtttttcagagatggctggaagagcataaacgaacgagagaaaccggtgaactgaatcgggagcaggacttcatggatatcttaatgtccacactggaagagacaaagatatctgaatacgacaatgacactatcatcaagtctacttgcctgagcattgtaacaggtggaaatgacactacaatggttactctcacttggatcctatccttacttctaaacaataaacatgcactgaagaaggttcaagatgagctggacagccacgttggaaagcatagacacgtggaagagtcagatatcaagaacctcatctacctccaagctataatgaaggaagccttgcggttgtaccctgcaggtccactatcaggtcctcgggtggcagacgctgactgcaccttagcaggctaccacatcccagcaggcacccgcttacttgtgaatacctacaagattcaaagagatccattggtgtggtctgagccatctgagttccgaccagagagattcctcactagccatgtaaacatggatgttaagggtctgcaatatgaattaataccttttgggacaggtaggcgtgcgtgtccagggatgttatttgcgcttcaagtggtgccactagtcctggctcggtttctacatgagttcgagccaaagactgaaatggatatgccagtggatatgacggagactgcgggactaagtaacgccaaagcaacgccactagaagtagtaatcaccccacgccttcagcccgagctttatagtttataa

SEQ ID NO: 123 - DNA, 1587 bp, Xanthoriza simplicissima
atggacttcaccatgatcatccaatggcttctcacatcctttgctattcttgttgcatttgttctaatctggtctagtgcaacaagatctagtactaggaaaagaaacaaaacagcacctgtagctgctggtgctttgcccattgtaggacacctacatatgctaatgggacgagaactgcctcatcgattgctttcaaatatggctgacaagtatggtcctgccttcatgatgaagtatggcttacaacctgcacttgtggtgagcagtttgaagctcactaaagagtgttttgttcacaacgatagagctgtttttaaacgtccaagaagcaaagcattgaaaaacttgacctatgatcaagcttctttgggttttgcgccatatggaccactttgggtggagatgcgaaaagtatctaaaactaatctcctctctaaccaaaggcttcaaatgcaaagacatgtaagagcctcagaagtcgacgctttcatcaaagagctttacgatctatggtcttccaaatccaacaacatcaaaggcgcgccacttttggttgaaatgaataaatggtttgaagaactggcacttaacgtagtgaccaggatgctgagtggaaaaagacacattggctttaaggcaaggcgtggtgaagatagtgaatctatgcattataagaaagttgtagttgatgctactcttttaactgcaaagcttgttgtgtcagatttctttccttctcttggattggtggactacttgcaaggtgacgagagctctataaaggggacaagcaaagaactagacgcgatcctcgccacttgggtggaagagcatcgccataagaaggtttcaggctcagaggatgatgagaaagacttcattgatctcactttgtccatgatagatcaaactcagcaccaaggtgcagatgtcgacaccttcatcaagtctatgtgtgtgggcatgatctttggtgggagtgatagcacatcagtggccttagcatgggctctttccatactgatgaataatcgtcctgttttgaagaaagcccgagaagaaatcgatcgacaagtaggtagagataggaaagtgaacgatttggatgtcctcaaattggattatctcaaggcaatcgtaaaggaatcgatgcgattatgcctagtcggaccgcttcttgaacgcgtcgccgtagaagattgtgagataggcgggtatcatgttaaagcaggctcgcgcgtagtagtgaatatttggaaaatgcaacatgatccaaacttatggtctgatcctttggaattccaaccagagagatttctcactacaaacgcaaatgttgaacttagaggccagcatttcgaactccttccatttggagctggtagtcgtatttgtcctggaattacatttgccctcgaacttattcagttaacacttgctcgtctaattcatggatttgaactgggaactccgatggatgcagacgtcgacatgacagaaacatcaagtgttaccaactatagggcaacacctcttgaaatattactaacaccacgcctggatccaaagctttacaattattag

SEQ ID NO: 124 - protein, 532 aa, Argemone mexicana
MDNFLLQFQPISIAAFFVALVFLYWSYGRKSNKTLKPRAPEAAGGRPITGHLHLFYGEELTHRKLGSMADKYGPVFNIRFGSHKTLVVSNWEIVKECFTTNDRLFSNRPGTLAIKLMFYDTDSVGYAPYGNYWRELRKISTLKLLSNHRIETLKHLRTSEVESCFKQLYNQWEMKNENRVEVDKLGFASVRMDNWFGDLTFNVVARIVAGKKNFAGGAVNGDIGAQRYKVAMDESFRLMLTFAYSDVIPSLKWLDKLRGLIRDMKRCGSEIDSIVASWVEEHRLKRNSSENNNLDLEEDFIDVCLDIIESSSLPGDDPDTVIKSTCLDMILGGSDTTTVTLTWAISLILNNPHVLKRAKEELNSVVGKDRRVEDSDIPHLTYIHAIIKETMRLYPAGPLIERRTMEDCEVGGYHVPAGTRLLVNVWKMQRDGDVYKDDPLVFRPERFMTSNADVDLKGQHFELIPFGAGRRICPGVSFAVQLMHLVLARLLHEFEITTIPSEPKVDMSESGGLICHKIKPLEVLIKPRLELN

SEQ ID NO: 125 - protein, 537 aa, Argemone mexicana
MDFSSILLLLNINCFTTSLVTLLVLVMVFLYNNTRFTKPKGNKKMIKPPRLPGARPLLGHLHLFGPGELPHKVLSTMADKYGPAFTIKFGKHTTLVVSDIHTIKECLTTNDILFSNRPSSIAFDLMTYADDSVAFAHYSPYWRELRKISTLKLLSNNRLQSIKQLRLSEVNVCFKELYSLCNNNNKSGAPVLIDMKKWFKEVTTNIVIRVIVGKQNFGSKIVRGEDQEAANYKKIMDELSRLAKLSMFSDYAPLLSLFDYFRGNVSAMKRNGKELNAMLQNWLEEHKRKKNSSISNDDEQDFMDLMLSIIDETKLYGRDADTFIKAISLSMIVGGIDTVVVTLTWILALIMKNPFALKKAQEELDFFVGKERQVEDSDLKNLVYMNAIVKETLRLYPLSCILERDTKEDCEVGGYYVEGGTRLLINAWKLQRDPNVWTDPSEFKPERFLNENADIDVGGQHYELIPFGAGRRVCPGVSFALQFMDLVLARLIHGYELGTLNGEDVDLTEKTEGQINFKATPLDLIVTPRLHPNLYDY

SEQ ID NO: 126 - protein, 522 aa, Berberis thunbergii
MESIEFLVTLLLSLLALFCAYAWKRKNHTKDSKIKEPPQPAGAWPIIGHLHLISRGGLPHINMGAMADKYGPVFMIRLGVNRAVIVSNTEIVKECFTTNDKFLLNRPVGLALNLMCYNNAMFGFCRYGPYWREIHKIVMLELLSNSRLESLKHVWDSEISTSIEELYQLCQTQNKTHEGPVLVEMKDWFADMALNVSLRMIAGKRYFGASAGGNKDEARKCQKTIRDFFRLVGLFIVSDALPFLRWLDLGGHQKEMKRTFEDLDYMLQGWLDEHKLNRKSGVNGDQDFMDVMLSILDDSKFPDYDVDTVNKATCFQLIIGGTDTTTVTLTWALSLMLNHPHVLKKAQDELDIQVGKHRQVEESDIKNLKYLEAVIKETLRMRPVGPLLGPRETIEDCTIGGYRVRAGTRVMVNAWKVHRDPSVWSNPDDFKPERFLKKDIDFRDQNFEFIPFGSGRRACPGISFAVEVLPMALARLLHGFELKTQLGCKVDMTEHAGLVHAKATPLEVLVSPRLSRELYVSS

SEQ ID NO: 127 - protein, 514 aa, Berberis thunbergii
GSLALIAIIILSNIVKKSSKSLSSKGGKSAPVVHGAWPVIGHLHLLMGKELPHHALAKLADKYGPAFTLNIGAYQELVISTRDLAKECFTTKDKFFLNRPSNKAMKILTYGEASVGFAPYSPLWVEMRKVTKSNLLSHQRVLMQNRSRASEIDASFKQLYEQCNGKSGASVEMKNWFEEVMLNVVTRNVSGKRSFGTKARLGDAEAVKYKRVIDETARFMGNLVISDMVPSLWWLDNMLGAESAMKKLAIELDSLLGGWVEEHRGKKLSDDEEGDFISLTWEMIDQIQLHGLAPETFIKSMCVGVLLGGSDTTSVALTWALSLMLNNREVLKKAQEELDFHVGKDRKVDDSDLKNLVYLQAIMKETMRIYQVGPLIEREAVEDCEVGGFQIKKGNRILVNLWKLQRDPEVWSDPSEFRPERFLEDKSKVDLKGQNAELMPFGSGRRMCPGVWFGVHSTSLVLARLIQGFEIETPLDAKVDMTETSSVTNYKGSPLEVIARLPGSNLSFMICSYV

SEQ ID NO: 128 - protein, 545 aa, Chordyalis celanthifolia
MTPSISQPFELLLLLMTMESLLLQWQPTSIAVLLLAITIFLYTFTKSPPKTHKKLAPDATGGRPLMGHLHLFNSNELTHRTLGSMADKYGPAFNIRFGSHKTLVVSTWEIVKECFTTNDRSFSNRPGTLYIKLMFYNEDSVGYAPYGAYWRDLRKLSTLKLLSNHRLESLKHLRVSEMNECFKQLYEICNKGSKSVAVRMDNWFGDLTFNVVARIVAGKRNFASISNDVGAMRYKNAMDEAFRLMTVFSFSDVIPSLGWLDNLRGLVGDMKKAGKEIDSVVSGWIEEHREKRKRRSSGGNNRDGELEEEDFIDITLSILETSSLPGDDPDMTIKSTCLDMILGGSDTTTVTMTWALSLLLNNAHALKRAREELDLHVGRDRQVEDSDINNLVYIQAIIKETMRLYPAGPLIERMTKEDCEVGGFHIPAGTRLLVNLWKMQRDPNVWEDPLEFRPERFLTNNAEIDLKGQHFELIPFGTGRRICPGVSFALQLMHLALARLLHSFEVASPMDAKIDMTETAGLISHKVIPLEVLMTPRLDSKLYDY

SEQ ID NO: 129 - protein, 523 aa, Chordyalis celanthifolia
THTTEKNLPPEVPGALPVIGHLHKLGGRKGLLPYHVLGAMADKYGPAFTFQFGSNRTLVISNWEMVKECFTSTNDKLFAYRPTALFNKEVFCSDHSFGFGPYGPFWREMRKVCSLHLLSNYRLELLKHSRKSEMDECFKELYQLWSASNISKDKQPAVLVVEMKKWFEDAMFNVASRVVVGKGSLKSHEKAGGSDNEVARNKYKKGMDEARRHMGTFVISDRIPFLWWIDYLRGIHSSMKRTAKDLHAIVETWLEEHRLHCHKRRVLQLDANHEVEDMAKEEEKDFMDVLLTMADEGAIKIFDHDLDTVIKANCLDMVIAGTDTPTVMLTWTLSLLLNNPDVLKRVRDELDLHVGKERQVEESDVKNLVYLQAVFKETLRLYPAVPLNERLTMEDCNVGGYDIPAGTRLLINIWKVQRDPNVWQDPSEFRPERFLSKEKSTIDVRGLDFELIPFGTGRRMCPGISFSLQLMHLGLARLIHGFELATPMDLDVDMSANPGAFNYKSTDLQVLVSPRFHSKFYGC

SEQ ID NO: 130 - protein, 536 aa, Chordyalis celanthifolia
MDFLALQWFPASLTALLALAVLYNFWTKQRTYKNGKTSTKQAPVAAGAWPVLGHLHLFGGGELPHKMLATMADKYGPAFTMKFGTHQTLVVSNTKIVKECFTTNDTLFANRPSTTAFHLMTYDNESVAFTPYGPFWRELRKISTLKLLSNHRLQAIKDVRASEVNVCFRELYSQWRINKSEPETSDHQGPILVDMKKWFEEVSDNVVLRVIAGKQNFGSKIVHGDKEALHYKKIMDEILRLAAVSMLSDVAPLLGWLDMFQGHLSAMKRNAKEVDTMLCNWLEEHRTKRLSSDHDGVEQDFIDVMLSIVEENKFSGHDNDTVIKATVLAMIMGGTDTTAVSLTWIVSLLMNNRHVLRRAQDELDLHVGKDRQVDDSDLKNLVYLNAIVKETMRLYPLGALLERETKEDCEVGGFHVKGGTRLLVNVWKLQRDPSFWTDPTEFKPERFLADKANIDVGGQHFELLPFGAGRRVCPGVSFALQFMHLVLARLLHGFDLATPMNADVDLTESTEGHVNQKASPLNLLVTPRLHSKLYEY

SEQ ID NO: 131 - protein, 543 aa, Chordyalis celanthifolia
MEYTFSSASLFSSSSLQQWLSTLLLLISSITISLYLTRRGKSSPPMVPGAWPLIGHLHLLGGNDPLHIVLGTMADKYGHTFAMLFGKHPSLVVSSSDIVKECFTSTNDKLFSHRHVPTGVKYMFYNNDSFGFAPYGPYWREMRKMNSLSLFSHHRVEMLNRIRTSQINIWFKNLYEMCTKEKSTSTSSDGVVVEMKSWFDEMFFNVLVNMIVKPINDDEELVKKYREVATEAGRLLSSMAVSDMVPSLGWLDHLFGIVGKMKKTAKDMDAILTTWLEQHKIKSQQLRRSNGGEGAADQTEEEEKEGKGLIGDLLSMQESALFGHDRDTVIKSACQALIMAGSDSTSATLTWVLSLLLNHRDALRKAREELDQVVGKDRQVDDSDIKDLVYLQAILKETMRLYPAAPILERLAVEDCIVGGFHVQAGTTLFVNVSKLQRDPNLWTDPLEFKPERFLTGCNADVDLKGQDYELVPFGSGRRSCPAVSFAVRVMLLVLARFIHSFEVKTREEDGILDMTESSGHTNCRSSPLEVLISPRLDSKIYC

SEQ ID NO: 132 - protein, 528 aa, Chordyalis celanthifolia
MEYYSSLPFLQQWPLSSISSSPTSIATTLLIVACFTIVFLYINTSSKSNNNLKSPPKLPGAWPFMGHLHLLGGNQPAHVSLANIAEKYKSTPFMIRMGQHSTLVVSSVDLVKECFNNTNDKLFSNRSIARGIRDMFYDMESFGFAPYGYYWRELRKVSALTLFSTHRVDSVIQIKTPQIDGWFKKLYEQCTNTKGGIVEIKSWLDEMMFDVLVKMLVEPKDEGSVEKYRHVAGEALEVLGNMSIYDLVPSLGWLDHFTGLVKKYKVTGKKMDTILNSWLEDHRGEKVAEEHKGLIGKLLSMKEGSKLLGHDGDTAIKSTVQVLILGAGDSAGATLTWAISLLLNHPHIMEKLRKELDAAVGKDRQIEDSDVKKFTYLLAILKETMRLYPVTTLLQRETMEDCAIGGYHVAAGTRLMVNVWQVQRDPNAWSDPLEFKPERFLTECAHVDFSGQYSELIPFGTGRRICPALTLSVRLMLLTLARIIHSFDVKIPNGASSVDMATSVGFVNLRLTPLEVELSPRLDSKIYG

SEQ ID NO: 133 - protein, 537 aa, Chordyalis celanthifolia
MDSSLLQWYTTASMAALLALAFFYKLWSKPRTSKNGKSTLQAPVAAGAWPVLGHLHLFSGGELPHKMLAAMADKYGPAFTMKFGTHRTLVVSDTKIVKECFTTNDTLFANRPSTMAFHLMTYDNESVAFTPYGQFWRELRKISTLKLLSNHRLQAIKDVRASEVNFCFRTLYNQWRINKSETIGTGDHQGPILVDMKKWFEEVSNNVVIRVIVGKHNFGSKIARGKGEALHYKKVMDEVLRLAAVSMLSDVAPLLGWFDHLQGHVSAMKRNAKEVDTLLCSWMEEHRKKRTSNGSNGVEQDFIDVMLSIVEENKFSGHDSDTVIKATVLAMIMGGTDTSAVSLTWIVSLLMNNRHVLRRAQEELDTHVGKDRQVDDSDLKNLVYLNAIVKETMRLYPLGALLERETKEDCEVGGFHVKAGTRLLVNVWKLQRDPNFWIDPTEFKPERFLTDNANIDVGGQHFELLPFGAGRRVCPGVSFALQFMHLVLARLIHGFELDTPMNANVDMTESTEGHVNHKASALDLLITPRLRSTLYDY

SEQ ID NO: 134 - protein, 571 aa, Chordyalis celanthifolia
MFKSVPSAQAILHKLSFIHQYFLLSQTNMDSLLFQWFPASMAALVAFAFLYKLWSAPKITKNGKTSTKQAPIAAGAWPVLGHLHLFGGGELPHKMLAGMAEKYGPAFTMKFGMHRTLVVSDTKIVKECFTTHDTLFANRPSTTAFHLMTYDQESVAFTPYGPFWRELRKISTLKLLSNHRLQAIKDVRTSEVNVCFRGLYNIWQTNKNEQGGTVSDHPRPVLIDMKKWFEEVSNNVVIRVIAGKQNFGSKIVRGEEEAVKYKKIMDEVLRLAAVSMLSDVAPLLGWLDLFQGNLSAMKRNAKEVDNMLNAWVEEHRRKRLAHSAKVEATHVEQDFVDVMLSIMEENKLSSVHDDDTVIKATVLAMIMGGTDTTAVSLTWTVSLLMNHRYVLKKAQEEIDQHVGKERQVEDSDLKNLVYLNAIVKETMRMYPLGALLERETKEDCEVGGFHVKGGTRLLVNVWKLQRDPNVWIDPTEFKPERFLAENANIDVGGQHFELLPFGAGRRVCPGVSFALQFMHLVLARLIHGFELETPMNADVDLTESTEGHVNHKASPLDLLIAPRLNSKLYEL

SEQ ID NO: 135 - protein, 533 aa, Chordyalis celanthifolia
MDSLFVLLQWFSASLAAVLALAFLYNLWVKPRISDGKGNKGSTKQAPVAAGAWPVLGHLHLFGGSELPHKMLAAMADKYGPAFTMKFGTHRTLVVSNTQIVKECFTTNDTHFSNRPSTTAFHLMTYDNDSVAFTPYGPFWRELRKISTLKLLSNHRLQAIKDVRVSEVNVCFKDLYNQWKTNQNQRPVLVDMKKWFEEVSNNVVIRVIVGKQNFGSKIVRGEEEAVKYKKIMDEILRLAAVPMLSDMAPLLGWLDLFQAHKSAMKRNAKEVDNMLESWLEEHKRKRLSGVNGAEEEDFMDVMLSIMEENKFTGRDSNTVVKSTVLAMIMGGTDTTAVSLTWIFSLLMNNRHALKKAQEELDMHVGKDRQVEDSDLKNLVYLNAIVKETMRMYPLGALLERETKEDCEVGGYHVRAGTRLLVNVWKLQRDPSFWTDPTEFKPERFLTENAKTDVGGQHFELLPFGAGRRVCPGVSFALQFMHLVIARLIHGFELGTPMDADVDLTESTEGHVNHKATPLDLLIAPRLDSKVYDY

SEQ ID NO: 136 - protein, 530 aa, Chelidonium majus
MRSNYLKPTTTTIEDKSKNKISRKKPIAAKPPPEALGAWPVIGHFLLFTGKGLTHVTLGDMADKYGPAFLIRFGSHRTLVVSSWEMMKECFSAPNDKIFSNRESNLLWIKSMFYGSNSYGFSPYGPYWKELRKISTQKLLSHHRLDAMKHLQMVEVDASFKQIYNLCNKNGGSPSPSSINTTALVNMDEWLSHLMFNVIARMVSGYQSDDVGTGATSTGERFKVSMDETMRLMAIFAVSDLVPWLACVDRLRGLTRKMNRCGKDLDSIIGRLIEEHRQKRRLCRNNKGSKNEDGGHDDDQDFIDICLSIMEQSQLPGDNPEIAIKSIVLDMIFAGSHTTTLAMTWTLSLLLNHRHMLKKAKEEIDAHVGNERQVDDSDIHNLVYIQAIIKESMRLYPPSPLFERMTMEDCEVGGFHIPAGTRLFVNVWKMQRDPTVWEDPLEFRPERFLTSKREIDVKGQHYELIPFGAGRRICPGASFTLQVLHLVLARLIHGFEMTTPMDVKVDMASSAGLFSNKMTPLEVLITPRTA

SEQ ID NO: 137 - protein, 557 aa, Chelidonium majus
MKILQEFHQLTISNIVLLLLISFIFFSLSAWFIESTNYYYSSKKKKSKKTPPPEASGAWPVIGHLHQFKPDDLPHEALGDMADKYGPVFIVRFGSYRKLVVSNSEMVKECFTAANDRSFSNRPAVLGIRIMLYNTITYAFAPYGPYWRELRRISSQNLLSNHRVDMVKHLHVDEVNTLFKQLYELCNKNGGRPPTGTNTSTSAALVNMDDWLSNIMFNVIARIVNGNNKSINNERTGAINEKRYKTAMDEARRLVAIFAVSDSVPWLGWLDRVRGLIRGMNLCGKELDSIIEDIIDEHRQKRRLCTSKLGSSGDDDADNSNLEEEDNFIDACLSIEEQSQLPGENPEIVIKALILDMFAGGSDGPHFVLTWTLALLLNHPHVLKKAREEVDAHVANDRHVDVSDISNLVYIQAILKESMRLYPPNALIERMTTEDCEVGGYHIPAGTYLLVNVWKVQRDPTVWQDPSEFRPERFLLTNTKTEMEYEHIPFGAGRRRCPGMRFALQVMHLVLARLIHEFEITTPVDVIKVDMTATNGLFNHKAVPLEVLLTPRTLIRG

SEQ ID NO: 138 - protein, 541 aa, Chelidonium majus
MDYSVLLQYGWFAPSMAALLALAFLYNLFLASSPKATSKRTISTKKPPMAAGAWPILGHLHLFKEGELPHQMLKSMADKYGPAFLMKFGQHRSLVVSDYRIVKECFTTNDTHFCNRPSTTAFDVMTYANESVAFTEYSPYWRELRKISTLKLLSNNRLQAIKNLREEEVNVSFKGLYDSWKNKNNKSTGSVGDERAPVLVDMKKWFEEVSNNVVIRVIVGKCNFGTKIVQGEKEGVEYKTIMDELLRLASLSLLSDFAPILGLLDFFQGHVRTMKRNGKKLDVLLQRWLEEHKRKKSTPEDEQDFMDVMLSVIEESKLSGYDADTVIKATCLAMIMGGTDTSAVSLTWIVSLLMNNRHALKKAREELDAQVGKDRQVEDSDLKNLVYLNAIVKETMRLYPLGTLLERETKEDCEVGGFHLEGGTRLLVNVWMVQRDPSVWTDPTKFTPERFLTEKADIDVWGGNFELIPFGAGRRVCPGVSFALQFLNLVLARLIHGYELGTPDDADVDLTESPEGHLNHKASPLELLLTPRLSNPKLYDY

SEQ ID NO: 139 - protein, 537 aa, Chelidonium majus
MEFLSLEPQLISIFVLLLASSIFLYNLLKNHGRKSKTSKPPAPVASGGWPIMGHLHLFNGSELTHQTLGSMADKYGPAFNIQLGSHQTLVVSSWEIVKECFTTNDRFFSNRPGSLAIKLMFYDADSVGYAPYGAYWRDLRKISTLKLLSNHRVETLKHLRTSEAESCFKQLYNQWKNNKVGGDDDEFAIVRMDNWFGDLTFNVVARIVAGKKNFAGGATSGDVGAKRYKEAMDEAFRLMTIFAFSDVVPSLGWLDKLRGLVGGMKRCGAEIDSIVGGWVDEHRLKRASRKGGDHNDLDLEQDFIDVCLEIMEHSTLPGDDPEIVIKSTCLDMILGGSDTTTVTLTWALSLLLNNPHVLKRAREELDTHVGKDRQVDDSDMSNLVYIQAIIKETMRLYPAGPLIERRTSEDCEVSGFHVPAGTRLMVNLWKMQRDGSVYKEDPLEFRPERFLTSNADVDLKGQNYELIPFGAGRRICPGVSFAVQLMHLVLARLVHGFEMKTAGGAKVDMTESAGLISHKVTPLQVLLKPRLAIQQAL

SEQ ID NO: 140 - protein, 550 aa, Chelidonium majus
MDSMNLFQQAIAVGTLVIFLYYLWKWTSIIFTRTHQAAPPEPAGAWPIIGHLHLLAGGANQLVYHILGSMADKYGPIFTVRLGMRRALIVSNSELAKECFTTNDRIFSTRPSSVAIKLMGYDSAMFGFAPYGPYWREMRKIAVTELLSNRRLEILKNIRISEINMSIKDLYQLWVENKNSGVDGGGDGGEVVVGSPVLVEMKRWFEDVSFNVVVRMVAGKRYFGRRVESDDREEEEARRWQKAMNDFMHLVGIFVVSDAIPFLGFLDFQGYEKEMKKTAVEIDYVMGRWVEEHQRRKLERVAGGSDDQQEDFIDVMLSILKDGDQFYGYDPDTVIKSSCLSLVLGGSDTISVTLTWTVSLLLNNRNVLEKAQSELDIHVGRGRQVDESDINNLKYLQAIVKETMRLYPAGPLSAPREAMEDCTIAGFHVPKGTQLMLNLWKLHRDPRVWSDPLEFKPERFLTTGTHGDVDVKGQHFELLPFGAGRRICPGISYALQVLHLTLARLLHSFHLSTPYDIPVDMTESSGLSCPKATPLDVLLTPRLPSELYVS

SEQ ID NO: 141 - protein, 561 aa, Chelidonium majus
MDLFIFFSRFQYIVGLLAFLTFFYYLWRVSITGTRIKTNQNIMNGTNMMAPEAAGAWPIVGHLPQLVGPQPLFKILGDMADKYGSIFMVRFGMHPTLVVSSWEMAKECFTTNDKFLASRPTSAGGKYLTYDFAMFGFSFYGPYWREIRKISTLELLSHRRVELLKHVPYTEIGGSIKQLYKLWMETQNQNKQRDDHQVKVDMSQVFGYLTLNTVLKLVVGKGLFNNNDMNHEQEEGRKLHETVLEFFKLAGVSVASDALPFLGWLDVDGQKRSMKRIAKEMDLIAERWLQEHRQKRLTSNNKASSGHDDFMSVLLSILDDDSNFFNYNRDTVIKATSLNLILAASDTTSVSLTWVLSLLVTNPGALKKVQDELDTKVGRNRHVEERDIEKLVYLQATVKETLRMYPAGPLSVPHEATQDCTVGGYQVTAGTRLVVNVWKLQRDPRVWPNPSEFKPERFLPDGCEVGCGEAANMDFRGQHFEYIPFGSGRRMCPGIDFAIQIIHMTLACLLHAFEFQVPSSLDKHLVPAVIDMSEGSGLTMPKVTPLEVLLNPRLPLPLYEL

SEQ ID NO: 142 - protein, 522 aa, Cissampelos mucronata
MEAMGEYFQLISWTVFSALITIYFIFSRKTNGKKKAPEPGGAWPIIGHLHLFGAHDLLYRKLGAMADKLGPVFMIRFGMHRAVVVSNYEVAKECFTVNDKILASRPRIIASKLMGYNHAAVGLSPYGPYWREARKIATLELLSNHRLQLLKHIRISEIDMWIKELKEFCMKSSSDGPVLVQLDGWFNALTLNIMVRNIAGKRYCGGAEAFEDEESQRWKKVSRELMFLFGVFMVPDAFPVLEGIDVQGFERAMKRVGKEMDFFLSRWLEEHRRKKIELSEKGNEVNDQGAQDFIDVMLNTIKDAKIFEHDADTMIKATCMALVVAGNDTTMITLSWAVSLLLNNRGVLEKAQEELSNQIGKNRHVEEGDIESLPYLHAIVKETFRLYPAAPLSLPHEAMEDCTIAGFHVPAGTRLITNIWKLHKDPNIWPDPLEFKPERFLTTHAHVDFKGQHFEFIPFGSGRRMCPGSSLAISVLHLTLARLLHEFELKTPDDAPVDMTEGPGITLMRANPLHVLINPRHD

SEQ ID NO: 143 - protein, 534 aa, Cissampelos mucronata
MSSPIQQLLLSLTSINGGTIISAVIISLLLILTLHRLLKPINSNKTKHPPRASGAWPVMGHLHKLRGPDLPHRTLSSMADQYGPIFTINLGPTTALVISDPAVAKECFTTNDLTFSSRPTTLATTLMCYNNTMFGFAPYGPYWREVRKVVMAQLLSTRRLESLKNIWASEIDRWVKGLAQKAQSGSHGVVEVEMGDWLARLTMNIGLRLVVGKSCGEMGSEESERCLGAMREYPELLGRFALEDALPWLGRFDLQGHQREMRRAARVLDEILDGWLDEHKRNRSGLSGGDDHRDQDFMDVMLSVLEQDQDSSLSDHDADMINKSTCLNLILGMADTTMVALTWAISLLLNNKTSLKKAQEELQAQVGNERHVDESDVKNLVYLQSIIKEVLRLYPPEPLSGPREALEDCEVAGYHVPRGTRLIANLWKIHRDSSTWQDSMEFRPERFLTAHEHVDVWGQHFEFMPFGSGRRSCPGVSFEVRVLPLILARLIHAFEMTTRGDVPVDMSERPGLVISKASPLEVMISPRLPLHLFE

SEQ ID NO: 144 - protein, 536 aa, Cissampelos mucronata
MEFHLLLQAVAATLVTFFLYELWALRKKFSRLTKTPSSKALLKAKCAPEPPGAWPIIGHLPLLVSAKQPHRAFAALAEKYGPAFMLRMGMSPMLIVSTKEVAKECYTANDHVFATRPVTTAGKLMAYDHSVMGFTPFGTYWREIRKIATVELFSARRIGMLKPVRQSEVSLWMKGLHEKWVHNGNSSVSVELKSQLEELTFNLLTQMVAGKRYYGSNVAKVDEKMAGLFRHAVQQFNYHLGNSEMYDALPFMAWLDFKGDAKAMKKTQKDLDFIMQTWLDEHRLKADQMRGDAINNTRDFLDVLVMMEKTGQFSSAIKDRDTTIKALALTQLVAGVDSMANTMVWVLALLMNNPEMLAKAQDELDNNVGKDRLVEESDIPNLKYLQALLKETLRMYPVGPLLVPHEATEDCHVAGYFVPRGTGLFINAWTIQRDPNVWAEPNCFNPERFLTTHAEMDVKGQNHELLPFGSGRRSCPGVGLALQVMHLTLARILQAFELKTQSGVGIDLEECSGILLSMMHPLQVMMAPRLPSELYD

SEQ ID NO: 145 - protein, 524 aa, Eschscholzia californica
MDSLILTNWFPISIASVLTLVFLYKVLLSSRTLKDKKIKTSPMANGAWPILGHLHLFGSGELPHKMLATMADKYGSAFRMKFGKHTTLVVSDTRIVKECFTTNDTLFSNRPSTKAFQLMTYDNESVAFTPYGPYWRELRKISTLKLLSNHRLQAIKDVRASEVNVCFKSLYDQCKNPSGAPILIDMKKWFEEVSNNVVMRVIVGRQNFGSKIVQGEEEAIHYKKVMDELLRLASLSMFSDFAPLLGFLDIFQGNLSAMKQNAKKVDAILENWLEEHRKKKNSVAESEQDFMDVMLSIANESKLSGHDADTVIKATCLAMIMGGTDTTAVSLTWIISLLMNNRHALKKAREELDALVGKDRQVEDSDLKNLVYMNAIVKETMRMYPLGTLLERDTKEDCEIGGFHVKGGTRLLVNVWKLQRDPNVWVDPTEFRPERFLTENADIDVGGQHFELLPFGAGRRVCPGVSFALQFMHLVLARLIHGYDLNTLNEENVDLTESPEGHVNHKASPLDLILTPRLHYKLYE

SEQ ID NO: 146 - protein, 532 aa, Eschscholzia californica
MDTASSISLLLPWAVVVPSIATLLALLLFLFITSPKTPKRKTSSKPPPTVLPGAWPILGHLHLFKEGESPHHMLKNLADKYGPAFVMKFGQHRSLVVSNTKIVKECFTTNDTLFSNRPSTTAFDLMTYAHDSVAFTPYSPYWRELRKISTLKLLSNNRLKAIKKLRGEEVDVCFRGLYGLWKNKTKNGAPVLVDMKKWFEEVANNVVIRVIVGKLSFGTKIVDGEEEAVEYKTVMDELLRLASLSLLSDMAPILGWLDFFQGSVRKMKQTGKRLDVLLEKWLGEHREKKNLVGEDEQDFMDVMLSIVEESKLSGHEADAVIKATCLAMIMGGTDTTAVTLTWIISLLMNNRHALEKAREELETHVGKDRQVEDTDLQNLVYLSAIVKETMRLYPLGTLLERETKEDCEVGGFHIQGGTRLLVNIWMVQRDPTVWNDPSAFKPERFLTDKSEIDVGGQHFELIPFGAGRRVCPAVSFALQFLHLVLARLIHGYDLGTPSNVEVDLTESLEGHVNHKASPLELLLTPRLNPKLY

SEQ ID NO: 147 - protein, 548 aa, Eschscholzia californica
MESEIQYQTATMASILSTNLILSSIFTAFLLYFLLKMSPFRSSKNKSRKQAPKPTGSWPIIGHLLHLQGPNLPHINLAALADKYGSVFSFRIGLRPALVVSSWEIAKECLTTNDRVFVSRPPLIAMKHMGYDHALFGFSPYGPYWRELRKLVNQELLSNTRIELIKHVWDTEINTFINDLYEVWAMKSNEGGGDVVVEMKQCLYDFTLNLTLKILTGKRYFGGGGSEELREEAGRCQKAVRNFLRLVGTFTAQDVIPFLEGWLDLGGHEKEMKITGKELDSLLQKWLEEHKVKKSSAGEEGQENRGGDEEDFMGVMLTKLRDHEKLLSYYDADTINKATCLTVILGGSDTTMMTLVWALALLVNHPHVMKKLQDELDTHVSKERQVEESDIKNLAYLQSVMKETMRRYPGTPLYVRESIEDCTIAGYDVPTGTRLVVNAWKIQHDPQVWSNPFEFNPERFLTTHKDIDVRGQNFELIPFGAGRRMCPGASLGLQVVHLTLARLVHGFEFKTPDGEPMDMTESIGLTNLKATPLEIMLTPRLSSKLYVC

SEQ ID NO: 148 - protein, 554 aa, Eschscholzia californica
MGLSFDLSSHNFLQFSNPTILIGLFGLLVYLLLVNLRKRISRKNEAPEVEGGWPIIGHLHHFMGGKNKLLHVAFGAWADKYGPVYTLRMGLNKVLVVNSAEVAKECSTTNDMLFMARPYRIASEIMGYGYAMFPIAPYGPFYLKMRKMVTQELLSNSRVDSLKHVWGSEIKNAIQELHKKVLSTKGGGPISMDMKGWVSNLTFRTAMKVICGGVGVDGGGGGGGATSPATSIGEHNYDEVGSFQKALKEFFVLLGEIRISDVIPFLGWLDMRTGYVEKMKDNGKFLDNLMEEMLEEHKRKRRSLTEEEEKDGGYVEQDFMDVMISKLNDPKLLSYYDADTINKSTCLTLILSGSETTMVSIVWALALLVSHPHVLKKAQDELDTLVGRERQVDESDIKDLVYLQAVVKEALRLFPPAPLSTPRVATEDCVVSGYHVPAGTQLFVNTWKIQRNPEVWPEPSEFRPERFFTTHKDFDVRGLHYDLHPFGSGRRACPGAGFALQVVHLTLASLLHGFEIKNPSDEPIDMTESPGVTNLKATPLKVLLTPRLFSKEVY

SEQ ID NO: 149 - protein, 561 aa, Eschscholzia californica
MEKPILLQLQPGILGLLALMCFLYYVIKVSLSTRNCNQLVRHPPEAAGSWPIVGHLPQLVGSGKPLFRVLGDMADKFGPIFMVRFGVHPTLVVSSWEMAKECFTSNDKFLASRPPSAASIYMAYDHAMLGFSSYGPYWREIRKISTLHLLSHRRLELLKHVPHLEIHNFIKGLYGIWKDHQKQQQQPTARDDQDSVMLEMSQLFGYLTLNIVLSLVVGKRVCNYHADGHLDDGEEAGQGQKLHQTITDFFKLSGVSVASDALPFLGLFDLDGQKKIMKRVAKEMDFVAERWLQDKKSSLLLSSKSNNKQNEAGEGDVDDFMDVLMSTLPDDDDSFFTKYSRDTVIKANSLSMVVAGSDTTSVSLTWALSLLLNNIQVLRKAQDELDTKVGRDRHVEEKDIDNLVYLQAIVKETLRMYPAGPLSVPHEAIEDCNVGGYHIKTGTRLLVNIWKLQRDPRVWSNPSEFRPERFLDNQSNGTLLDFRGQHFEYIPFGSGRRMCPGVNLATPILHMTLARLLQSFDLTTPSSSPVDMTEGSGLTMPKVTPLKVLLTPRLPLPLYDY

SEQ ID NO: 150 - protein, 565 aa, Eschscholzia californica
MNLSSKLMGSFDLFSLNFLQFSKPASMVIIGICSFLVYFSLLNLVRRVLAPSCTMKNGKTEPPEVENGWPIIGHLHHFMGKKNKLIHEIFGDMADKYGPTFTLRMGLTKVLVVSSAEVAKECLTTNDLVFIGRPPRVANSLLGYSFAMFPFSPYGTYYSQMRKIVTHELLSTSRVESLKHVWNSEINKAIQELHHKVVSVGGGSPVLIEFKRWFSDLTLRTTVKLICGKQYFGTDGATQASMTINGGGDDDEAGKFQEALREFFCLLGKFRVSDVIPFLGWLDFGTGYKEKKNRMFIDSLMEEWLEEHKMKRRLLNEADKKESRIEQDFMDVMISKLDDPNLLSHYDADTINKATCLTLILGGSDTTMVSLVWALTLLMNHPHVLKKVQDELDFHVGRERQVEESDMKNLVYLHAVMKEAMRLNPAGTLSAPRMSTKDCTVSGYHIPAGTHLFMNTWKIQRDPNAWVEPTEFRPERFLTTHKDFDLRGQNFELLPFGSGRRSCLGANFALQVLRQTLARLLHGFDLKTPSDEPVDMTGSAGLINMKATPLEVLVTPRLFSSELYG

SEQ ID NO: 151 - protein, 550 aa, Eschscholzia californica
MNLLIFFQFLLQFQVLVGLSVLLAFSYYLWVSKNPKINKFKGKGALLAPQAAGAWPIVGHLPQLVGPKPLFRILGAMADNYGPIFMLRFGVHPTVVVSSWEMTKECFTTNDRHLASRPSNAASQYLIYEVYALFGFSLYGSSYWRDARKIATLELLSHRRLELLKHVPYTEIDTCIKQLHRLWTKNNKNQNNPELKVEMNQFFTDLTMNVILKLVVGKRFFNVDDAADHEKEEARKIQGTIFEFFKLTEGSVSAGALPLLNWLDLNGQKRAMKRTAKKMDSIAEKLLDEHRQKRLSKEGVKGTHDHNDFMDVLLSILDADQGDYSHHPFNYSRDHVIKATTLSMILSSMSISVSLSWALSLLLNNRHVLKKAQDELDMNVGKDRQVEEGDIKNLVYLQAIVKETFRMYPANPLLLPHEAIEDCKIGGFNVPAGTRVVVNAWKLQHDPRVWSNPSEFKPERFLNDQAAKVVDVRGQNFEYLPFGSGRRVCPGISFSLQTIHMSLARLVQAFELGTPSNERIDMTEGSGLTMPKTTPLHVLLNPRLPLPLYE

SEQ ID NO: 152 - protein, 532 aa, Eschscholzia californica
MEFHFPLMEQFQPFFIFALLLASFIFLYKLFNFGNRITKNGKPTAPEASGGRLIMGHLHLFNGTELTHRTLGSMADKYGPAFNIRFGSHKTLVVSSWKIIKECFTTNDRFFSNRPGSLAIKLMFYDADSVGYAPYGSYWRELRKISTLKLLSNHRLETLKHLRTSEVDSCFNQLMNSWAENKNRGDSDFAPVRMDDWFGDLTFNVVARIVAGKKNFAGGAARGDAGAQRYKSAMDEAFRLMTIFAYSDVIPSLGWLDKLRGLVGDMKRCGSEIDSVVESWVDEHRLKRRVSKKGGELDLEQDFIDVCLDIMEHSSLPGDDPEIVIKSTCLDMILGGSDTTTVTLTWALSLLLNHPQVLKRAKEELDSQVGKERQVEDSDIPNLPLIQAIIKETMRLYPAGPLIERRTMEDCEVAGFHVPAGTRLLVNLWKMQRDKEVWSEEPLEFRPERFLTSNTEVDLKGQHYELIPFGAGRRICPGVSFAVQLMHLVLARLLHGFEMTTPMGEKVDMTESAGLISHKITPLEVLIKPLRV

SEQ ID NO: 153 - protein, 510 aa, Eschscholzia californica
MDSFLLAYWVPISVASIIAFVFLYNLFSSRTLQNKKIRTAPMATGAWPILGHLHLFGSGELPHKMLAAMADKYGSAFRMKFGKHTTLVVSDTRIVKECFTTNDTLFSNRPSTKAFQLMTYDNESVAFTPYGPYWREIRKISTLKLLSNHRLQAIKDVRASEVNVCFKTLYDQCKNPSGSAPILIDMKKWFEEVSNNVVMRVIVGRQNFGSKIVQGEEEAIHYKKVMDELLRLASLSMFSDFAPLLGFVDIFQGNLSAMKRNAKKVDAILENWLEEHRKKKNSVAESQQDFMDVMLSIVEESKLSGHDADAVIKATCLAMIMGGTDTTAVSLTWIISLLMNNRHALKKAREELDALVGKDRQVEDSDLKNLVYMNAIVKETMRMYPLGTLLERETKEDCEIDGFHVKGGTRLLVNVWKLQRDPNVWVDPTEFRPERFLTENADIDVGGQHFELLPFGAGRRVCPGVSFALQLHAFSTCSPHPWIRFEYSKRRKCGSDGEPRRTCEPQSIAS

SEQ ID NO: 154 - protein, 534 aa, Glaucium flavum
MEFLSLQLQPVSIFALLVASIFLYNFLIHGKKSNNKKTTKPPAPEASGGWPIMGHLHLFNENELTHRTLGSMADKYGPAFNIRFGSHPTLVVSSWDIVKECFTTNDRFFSNRPGSLAIKLMFYDADSVGYAPYGAYWRDLRKISTLKLLSNHRLETLKHLRTSEVESCFKELYNQWRNNKTGGGGDGFAPVRMDNWFGDLTFNVVARIVAGKKNFAGGAASGDAGAQRYKEAMDEAFRLMTIFAFSDVVPALGWLDKLRGLVGGMKRCGAEIDSIVAGWVDEHRLKRSSGKGSDADLEQDFIDVCLEIMEHSTLPGDDPEVVIKSTCLDMILGGSDTTTVTLTWALSLLLNNPHVLKRAREELDTNVGKDRQVDDSDIPNLVYIQAIIKETMRLYPAGPLIERRTSEDCEVGGFHVPAGTRLLVNLWKMQRDGSVYKEDPLEFSPERFLTSNADVDLKGQNYELIPFGAGRRICPGVSFAVQLMHLVLARLIHGFEMKTPEGGKVDMTESAGLISHKVTPLEVLLKPRLAIQHS

SEQ ID NO: 155 - protein, 561 aa, Glaucium flavum
MHAKLTLIKKMEFTIINSLEIQPIISTFALLTFSILLYKILLNHGRENKNNKPKTSSSSSSIPEVAGAWPIMGHLHLFNGDELMHHKLGSMAEKYGQAFYIRFGSHKAVVVSNWEMVKTCFTTNNQIFLNRPPMLAINLLFFPTDSLSYIPYGDHWRELRKFSNQKLLSNHRIETQKNLRKLEVDYCFKQLCNQSSKYFIINNMDDQDSKFALVRMDTWFDDVTLNVLARIIAGKKKFISGGATSSGDDDNAEARRYMEALDEGLRLMTSFTFSDVLPWLGWLDNLRGLAGKMKRCGAELDSVFAGWVEEHRVKRGSRKDGDDADLEQDFIDLCWESLEQVPGNDPAKIIKLICMEMILNGSGATAVTLTWTVSLLLNNPDVLKRAREELDTHVGSHRQVDESDIPNLVYIQAIIKEGMRLYPPGPFLERSTTEDFEIDGVHVPAGTRLWVNLWKMHRDESMYQEPLEFKPERFLNSNSDVDLKGQSYQLLPFGAGRRICPGVSFALPLMHLTLARLIHGFEMKLPVGVEKVDMTENGGIINRKATHLDVLLKPRLIAQQA

SEQ ID NO: 156 - protein, 536 aa, Glaucium flavum
MDTLSIQWIVPSIATLLALVFLYNLIFTSKKTTKTNNTRKAPMASGAWPVLGHLHLFGTGELPHKMLATMAENYGTAFTMKFGNHTTLVVSDTRIVKECFTTNDTLFANRPSTKAFDLMTYANDSVAFTPYSPYWRELRKISTLKLLSNHRLQSIKDVRVAEVNVCFRGLHVLCKSKIYGAPVLVDMKKWFEEVSNNIVMRVIVGKQNFGSRIVQGQEEAVYYKSVMDELLRLASVSVLSDFAPLFGWLDFFQGNISAMKRNGKKLDVILERWMEEHRQKKISSSSSIAASGAGEDDEQDFMDVMLSIIEETKLSGRDADTVIKATCLAMIMGGTDTTAVSLTWIVSLLMNNRHVLKKAREELDSLVGKDRQVEDSDLKNFVYMNAIVKETMRLYPFGALLERDTKEDCEVGGFHVEAGTRLLVNVWKLQRDPNVWKDPLEFRPERFLVENVDIDVGGQHFELLPFGAGRRVCPGVSFALQFMHLVLARLIHGYELETLNGEDVDLTESTEGHVNHKASPLDLLITPRLDSKVYNY

SEQ ID NO: 157 - protein, 532 aa, Glaucium flavum
MDSTLVLQCFVGSMAAVSALVFLYNLIFSSSKTTKGKVLRKAPMAAGAWPILGHLHLFGSGELPHKMLSKMAEKYGPAFTLKFGKHTTLVVSDTRVVKECFTTNDTLFANRPSTTAFDLMTYANDSVAFTPYSPYWRELRKISTLKLLSNHRLQSIKEIRVSEVNVCFRELFEMSKSKTDGAAPALVDMKKWFEEVSNNIVMRVIVGRQNFGSKIVQGDAEAVNYKNVMDELLRLASLSMLSDFAPLLGWVDMFQGNKNAMKRNAKKVDTILEGWLEEHRKKNKKMSSSENDEQDFMDVMLSIIEETKLSGRDADTVIKATVLAMIMGGTDTTAVSLTWIVSLLMNNRHVLKKAREEIDAIVGKDRQVEDSDLKNFVYMNAIVKETMRLYPLGAMLERDTKEDCEVGGFQVQAGTRLLVNVWKLQRDPNVWSDPSEFRPERFLSENADIDVGGQHFELLPFGAGRRVCPRVSFALQFMHLVLARLIHGYELGTQNDELVDLTESTEGHVNHMASPLDLILTPRLSNPKLYDY

SEQ ID NO: 158 - protein, 518 aa, Glaucium flavum
MFFTSSSKTTNKNTSKKPPMAPGAWPILGHLHLFKEGELPHHMLKSMADKYGPAFLMKFGQHRSLVVSDYRIVKECFTTNDTLFSNRPSTTAFAVMTYATDSVAFTEYSPYWRELRKISTLKLLSNNRLQAIKKLRESEVNVCFRGLYDSWRKNKSEQNGAGNSIDGGNERARPVLVDMKKWFEEVSNNLVMRVIVGKRNFGTKIVEGEKEAVEYKTIMDELLRLASLSLLSDFAPILRLFDHFQGHIRTMKRNGKKLDVLLQRWLEEHRRKMSTPEEEQDFMDVMLSIVDESKLSGHDADTVIKATCLAMIMGGTDTSAVSLTWIVSLLMNNRHALAKAREELDKHVGKDRQVEESDLKNLVYLHAIVKETMRLYPLGPLLERETKQDCEVGGFDIAGGTRILVNIWMVQRDPAVWNDATEFIPERFLTEKSDVDVWGGSFELIPFGAGRRVCPGVSFALQFLHLVLARLIHGYELKTPNDMPVDLTESTEGHVNHKASPLDLLLVPRLSDLKLYDY

SEQ ID NO: 159 - protein, 537 aa, Glaucium flavum
MDSILTTVVLLSILLYFLFSWQLNKYSATKKNTKSSKQLPPEPAGSWPVIGHLHLLAKGSNLPHINLGAMADKYGPIFMIRIGLNPTLVVSSWEVAREIFTTNDQVFSSRPIQVSTKHLGFDTAMYGFAPYGPYWREISKLVKREVLSNTRLEFLKPVWGSEINTSIKELYDVCVMKNKEEGGTGPIIVEMKQWFSDLALNMSVKLVAGKRYFGASQLGNEEAARWQKALRNCFRLVGLFVVSDAIPFLRWLDVGGHEKEMKNTAKELDDLLEGWLEEHKMKKKLSLSEVEAEKKERDRVDFMDVMLSTLEHEKASDYFPADTINKATCLALILGGTDTTTVVWVWALALLVNNPNVLKKAQDELDVHVGKKRQVDESDIKNLTYLQAIIKESMRLYPAATLGIRESTEDCTVAGYHIPAGTSLIVNSWKIQHDPQVWTDPFEFQPERFLTGHMDVDIRGQSCKFLPFGSGRRSCPGTSLALQMVTLTLARLIHGFEFRTPSEAPTDMTESAGLTNVKATPLEVLVSPRLPSELYVC

SEQ ID NO: 160 - protein, 537 aa, Glaucium flavum
MELINSLEIQPITISILALLTVSILLYKIIWNHGSRKNNKSNKNNRKTSSSAGVVEIPGAWPIIGHLHLFNGSEQMFHKLGSLADQYGPAPFFIRFGSRKYVVVSNWELVKTCFTAQSQIFVSRPPMLAMNILFFPKDSLSYIQHGDHWRELRKISSTKLLSSHRVETQKHLIASEVDYCFKQLYKLSNNGEFTLVRLNTWCEDMALNVHVRMIAGMKNYVAAPGSGEYGGQARRYRKALEEALDLLNQFTITDVVPWLGWLDHFRDVVGRMKRCGAELDSIFATWVEEHRVKRASGKGGDVEPDFIDLCWESMEQLPGNDPATVIKLMCKEHIFNGSGTSSLTLAWILSLIMNNPYVIKKAREELEKHVGNHRQVEESDLPNLLYIQAIIKEGMRLYTPGPFIDRNTTEDYEINGVHIPAGTCLYVNLWKIHRDPNVYEDPLEFKPERFLKNNSDLDLKGQNYQLLPFGAGRRICPGVSLALPLMYLTVSRLIHGFDMKLPKGVEKADMTAHGGVINQRAYPLEVLLKPRLTFQQA

SEQ ID NO: 161 - protein, 571 aa, Glaucium flavum
MDLQIFFHFQGIVGSLALLSFFYYLWRLLTTTKTSICNGTTAAPPEVSGGWPILGHLLQLVGSKQPLFKVLGDMADKYGPIFVVRFGMYPTLVVSSWEMAKECFSTNDRVLATRPTSAASKYLTYNYAMFAFTFYGPYWREIRKISTIELLSHRRVEMFKHVPFMEIDTCIEQLYLLWMQNQNQNQNQPNGDPVQVNMSKVFEELTMNAVLKLVVGKRLTDDKEGEKLHKTIQEFFKLLEVSVASDVFPFLGWLDVDGQKRKMKRVAKEMDIIAEKWLEEHRQKRSSKLEEEEEEEEDDGGGKGDAAAADKDFMDVLLSLLEGDEGDSDQPFMNYSRDTVIKATSLNILVAATDTTSPTLTWAISLLLNNPHVLREAQNELDMKVGRDRQVEEQDIENLIYLQAIVKETLRLYPAGPLSIPHEAIQDCKLGGYHVRAGTRLLLNIWKLHRDPRVWSNPLEFKPERFLILSEEVCGCSRGTQNFDFKGQCFEYIPFGSGRRMCPGYNFGIQIIHMTLARLLQSFEMQPAKAKSLNDQDGPVDMREGSGLTLPKITPLKVLLTPRLYGQLYNH

SEQ ID NO: 162 - protein, 534 aa, Hydrastis canadensis
MDFSMLFQWLLVTMATLLFLNSVYNVWYKSSKNTSITTTTSKGKKAPVAAGARPFMGHLHMLVGGKQLPHQALGKLADIYGPAFIIHIGPNPELVVSSWELAKECFTTNDKYFANRPTNKAMKYLTYDEASVGFGPYGPLWVEMRKIAKSNLLSQQRLQMHKRVRVLEIDAFFKELHELWSMKKEDGPVSVDMKQWFEELTLNVITRMVSGKHKYATKARRGDSEAKQFKRVIGEAAHFTGNLLLSDIFPSLGFLDNMQGRVNSMKRTGKELDSILSSWVEEHRQKKLSGEQSEDEEKDFIDLTLSMMDEIQLHSTDSETFIKAICVGVILGGSDTTSVGITWILSLLMNHRDVLKKAQEELDQQVGMDRKVEDSDLNNLVYLRAIVKESMRLYQVGPLIERKASQDCTIGGFHVKAGTRLLVNLSKVHKDPTVWSDPLEFQPERFLTTHSNMDLKGQHFELLPFGSGRRMCPGYLFALNEMYLVLARLIQGFELGTPMDAKVDMTETSSVTNYRATPLQVLLTPRLSPKLYDY

SEQ ID NO: 163 - protein, 528 aa, Hydrastis canadensis
MAFVALIVVYNIWFKSAASRNKTSYNNKTMSKTPVVDGAKPIIGHLHLLMGGDLPHHALGRLADKYGPIFLMHIGAFPELVVSSSELAKECFTTNDKYIINRPTNKAMTYLSYEQASVGFAPYGPLWIEMRKISKSNLLSNQRIHMQKQVRVAELDAFFKELYQLCRSNDENNNNSTSHGKVLVEMNKWFEELTLNVVTRMICGKQKMGTKARLGDSDAKHYKKTIDEAAHFMGNLVISDVVPCLGMLDNLLGHVSAMKRTGKELDTIFGSWVEEHQQKIRLSGYKDDAEEEEHDFIDLTLSMMKGSTDLHGLDPATFIKSICVGMILGGTDTTSVALTWILSLLLNNRHILKKAQEELDHQVGKERKVEDSDLNNLVFIGAIVKESMRLYPVGPLIEREAIEDCQIGGVHVKAGTRLLINIWKVQQDPKIWPNPSEFRPERFLDSNMDVKGQHFELIPFGSGRRMCPGMSFAINELNLVLARLLQGFELETPMNAKVDMTETSSVTNYKGTPLQVLLTPRLSSKLYM

SEQ ID NO: 164 - protein, 531 aa, Hydrastis canadensis
MEYSHLLPWLATSIAAIFAFIFLFYVRRRKNNKAFIHNHAKKAPVVPGALPFLGHLRLFTGPILPHKALGALADKYGPAFTIYLGSHQTLVVSGRELVKECFTTNDRLFSNRPRSKAVKYLTYDEASVGFAPYGPLWVEMRKVSKLNFLSNQRIQMQKQALASELNFCFKDVYQLWLKNKELPVMVDMTKWFEEMTLNVITRLICGKQNYGSKANSGESEAKRYKQVVEKAAHLTSTVVMSDVFPFLEWFDKFQGQEKVMKKVANEFDSILGSWVDEHRRKRLLRGNNEEEEEEQDFIDLSLAMMEETQLHGVDPDTFIKSMCLGMILGGGDTTPVALTWALSLLLNNPDIMKKAQEEIDQVIGKERKLDGSDISNLVYLQAVVKESMRLYQVGPLIERETTEDCKIGDFHVEAGTRLLVNIWKVQQDPCVWSNPTEFQPERFLSSKSDMDLKGQHFELIPFGSGRRMCPAVASALQMMHLVLAKLIHGFELGTPMNAKIDMTETSSITNNMATHLQVLLNPRLNANLYDF

SEQ ID NO: 165 - protein, 543 aa, Hydrastis canadensis
MADFTMLLQWLLLTMATLLFLNAVYKSIKSSKNTINDTSFKKGKKAPVAAGARPFIGHLHMLVGGKQLPHQALGKLADKYGPAFIINIGPNPELVVSSWELAKECFTINDRCFTDRPSNKAMKYLTYDEASVGFAPYGPLWVEMRKIAKSNCAFQQRLQVQKRVRVLEIDLFFKELHELWSHAGAGATGTSVIPLSIDMKKWFEELTLNVITRMVSGKHNYATKARKGDTEAKRFKRVISEAAHFTGRLLLSDIFPSLGFLDNMQGRVNSMKRTGKELDSVLSSWVEEHRQKRVSGNKEQSPEDDDVEQDFIDLTLSMMEEIQLHWTDADTFIKAICVGVILGGSDTTSVGITWILSLLMNHPDVLKKAREELDQQVGLERKVDDSDLNNLAYLRAIVKESMRLYQVGPLIERKAKQDCNIGGFHLKAGTRLLVNLSKVHKDPTVWSDPNEFRPERFFTTHTNIDIKGQNFELIPFGSGRRMCPGYLFALSEIYLVLARLIHGFELRTPNDAKLDMTETSSVTNYRATPLQVLLTPRLSSKLY

SEQ ID NO: 166 - protein, 532 aa, Hydrastis canadensis
MDYFSMPYQWLLTSLATLIVFVFIWSITAGKTSTTSNKAKKAPPIAAGAWPIIGHLHLIMGGELPHRLLSNLADKYGPIFMLNYGSQPGLVVSSLKLAKECFVHNDRAVFKRPNSKAMKYFTYDQASFGFAPYGPLWVEMRKVSKSNLLSNQRLQLQRNQRASEVDAFIKELYQLCKKSNNGTLMVEMNKWFEELTLNVVTRMVCGKKNIGAKARHGGDNEAKYYKKVIDEATIFTAKLVASDFFPSLGWVDYLHGDESAIKQTAKELDSIIGSWVEEHRQKRLLSLNKDDYAEQDFIDITLSMIDQTQHQGIDADTFVKSMCVGMIFGGSDSTSVALNWALSILMNNRHVLKRAREEIDTLVGKDRKVNDVDVTKLVYLKAIVKESMRLCLVGPLLERVTVEDCEIGGFYVKAGSRIVVNIWKLQHDPDLWSDDVMEFRPERFLTTNSNVELRGQHFELIPFGSGSRMCPGVTFALELMHLTLARLIHGFELGTPMDAKVDMTETSSVTNYKATPLEILLTPRLHPKLYDF

SEQ ID NO: 167 - protein, 534 aa, Hydrastis canadensis
MFISITQQSMDSFHQYLATIIFGVFSFVLFLIYYLPLKRSRSDKKRAAPKPVGAWPIIGHLPMLSRHQPPHITLGNIADKYGPAFTLQLGVHRALVVSSSEVAKECFTTNDKALASRPSSVALKLMGYNNAMFGFGPYGSYWRQMRKIVVLELLSNHRLQLLKHVRISEVSTSLKELYQVWASCTNKNDKGQVLVDMQQWFGDLTLNVSVRMIAGKRYFGASAACDEDEARRFQKAIKDFLHLVGLFVVSDALPFLEWLDIQGHQKAMKRTFKELDRILGKWVEEHRRNKLDGGTNVGRDFMDVMSSILDDANISDYDADTINKATCLSLILGGTDTTMVTLTWALSLLMNNQHILKKAQDEIDIYVGKDKNVDESDIEKLVYLQAIVKETLRLYPAGPLSGPHEAIEDCTVAGYHVPRGTRLITNLWKIQRDPRIWSSPCEFQPERFLTTQANVDVRGQHFEFLPFGSGRRSCPATSFALQVVHLALARVLQGFEFETQSNAPVDMTESAGLTNVKATPLEVLITPRLPLNLY

SEQ ID NO: 168 - protein, 529 aa, Hydrastis canadensis
MESLHQYLAAVMSCIFALLLFLYYFPWKIRRSSSDNNMRSAPEAAGAWPIIGHLPMLGGHQLPHITLGNLADRYGPAFTIRLGVCRALVVSSSEVAKECFTTNDKAFATRPSSVAVKLMGYNYALFGLAPYTSYWREVRKIVILELLSNRRLELLKHVRISEVNTSIKELFQVWASSNNKNEKGQVLVEMQRWFGDLTINVAVRMVAGKRYFGASVNTCDDEEEARRFQKAIKNFFHLVGLYVLSDSLPFLEWLDFEGHQKAMKRTFKDVDCILQRWLEEHRRDKENGAMKEERDFMDVMLSILKDANLFGYEADTVNKATSLNIILGATDTTMVTLTWALSLLLNNRHILKKAEDEIDIHVGKDKAVDESDIEKLVYLQAIVKETLRLYPVAPLLAAHEAIEDCIVAGYHVPRGTRLIPNIWKIQRDPRIWSSPCDFQPERFLTTQANVDVRGQHFELFPFGSGRRMCPGISFGLQVVHLALARVLQGFEFDTPSNKAIDMTESAGLTNLKATPLQVLITPCLPLNLY

SEQ ID NO: 169 - protein, 530 aa, Hydrastis canadensis
MDSILLPTPLMVSLFALLLCLYYLIISRPRSSHNTSTKEAPEAAGALPIIGHLHLLGGRILPHITLGAMADKHGPAFMIRIGVHRALVVSSSEVAKECFTTNDKAFASRPKHTAAELMGYNYAMFGFAPYGPFWSEMRKIIMAELLSNRRLELLKYIRDFELKASIKELYMTWENHSVTNKGQVVVEMKKWFGDLTLNVILRMIAGKRYFGSNSTCDESEAKICQKGMRDFFRLLGEFLVEDAIPYLGWLDLQGFKKEMKNTAKELDILLQGWLEEHKKKREFSKDVKEEQDFMDVMMTILEDANFSDFDADTINKATCLTIISGGSDTTMLTLTWALSLLLNNQHVLKKAQDELDTHVGRDRRVDESDIKNLVYLNAIVKETLRLYPASPLLGIRVSTEDCTVAGYHVPSGTRLMVNAWKIQRDPLVWSDPFEFRPERFLTTHVNVDVKGQNFNLIPFASGRRVCPGVAFALQMLPLVLAHLLHGFKLMTQLGGPVDMTESTGLTNIKATPLEVVISPRLRPELYEMYT

SEQ ID NO: 170 - protein, 525 aa, Hydrastis canadensis
MESLHQYLATILSCIFAFLLFLYYFPWKGRRSFDNNLRTAPEAAGAWPIIGHLPMLNQRDLPHVTLGNLADRYGPAFTIRLGVRRALVVSSSEVAKECFTTNDKAFATRPSSVAVKLMAYNYAVFGFGPYGSYWREMRKIVILELLSNRRLELLKHVRISEVNTSIKELYQVWASNNKNEKGQVLVEMQRWFGDLTMNVVVRMVAGKRYFGASVTCDEEEARRFQKAIRDFSHLAGLYVLSDALPNIEWLDFEGHHKAMKKTFKDLDCILQRWLEEHRRDRENGATKGERDFMDVMLSILKDANPFDFEADTVNKATSLNMVLGGTETTTVTLTWALSLLLNNQHILKKAQDEINIRVGKDKPVDESDIEKLVYLQAIVKETLRLYPVLPLSVPHEAIEDCTIAGYHVPRGTRLITNLWKIQRDPHIWSSPCEFQPERFLTTQANVDVRGQHFELFPFGSGRRMCPGISFGLQVVHLALARVLQGFEFETPSNVPMDMTESAGLTNFKTTPLEVLITPCLPLDQY

SEQ ID NO: 171 - protein, 525 aa, Hydrastis canadensis
MDSLLQLQIIGALAALIFTYKLLKVICRSPMTDGMEAPEPPGAWPIIGHLHLLGGQDPIARTLGVMTDKYGPILKLRLGVHTGLVVSNWELAKECFTTNDRVLASRPMGAAGKYLGYNYAIFGLAPHGPYWSEVRKIVLRELLSNQSLEKLKHVRISEINTCLKNLFSLNNGNTPIKVDMKQWFERPMFNVVTMMIAGKRYFSMENDNEAMNFRKVATEFMYLTGVFVVSDALPYLEWLDLQGHVSAMKRTAKELDIHVGKWLEEHRRAKLLGETKNEDDFVDVLLTILPEDLKDNQTYIHDRDTIIKATALALFLAASDTTAITLTWALSLILNNPDVLKRAQDELDKHVGKEKLVKESDIINLVYLQAIIKETLRLYPAAPLLLPHEAMEDCTVGGYHVPKGTRIFVNIWKLQRDPRVWFDPNEFRPERFLTTHANVDFKGQHFEYIPFSSGRRVCPGITFSTQIMHLTLAHLLHEFNIVTPTKSNAGVDMTESLGITMPKATPLEVLLTPRLPSNLYNQYRD

SEQ ID NO: 172 - protein, 521 aa, Jeffersonia diphylla
MDSLQLIASVVCGLFAFLRIYYLLKKLSSNKEAPQLGGAWPIIGHLHLLGRVELPHIFFSAMADKYGPAFMIQLGMRRALVVSSAEIAKECLTTNDKALATRPSSIAAEIMGYDYAMFGLGPYGDYWREVRKIVVLEFLSNRRLELLKHVRVSEISLSLKELYQSWEKQNKADEPVLVHLDQWFGDMTLNLSVRMVAGKRYFGATAACGEDESRKVQKATREFDRLLGLFVVSDYLPFLRWLDLEGHQKLMKSIGRELDSILQGWLDEHKTRRNSGGGAKGDQDFIDVMLSVLEDGNLSNYDADKLNKATSLTMIVAGSETTMVTLTWAVCLLLNNPEVLNKAQDELDMHIGKDRQVEESDIKNLAYLQAVIKETMRLYPVAPLLIPHEAMEDCTIAGYHVRAGTRVILNGWKLQRDPFIWSDPCEFQPERFLNNDVDVRGRHFELLPFGSGRRACPGISLALNVVSLTLARLLHEFKFSNPSEGKVDMSESAGVVVAKATPLEVLIIPRLPSKFYEYYKL

SEQ ID NO: 173 - protein, 518 aa, Jeffersonia diphylla
MFSLQLLSTPLFGFFTLLAIYYLLWTKSNKTKEAPQPAGAWPIIGHLHLLARSELPHITLGAMADKYGPAFMIRLGTRQAIVVSNSEIAKECLTIKDRIFATRPSLVAFKLMGYNSAMVGLSPYGPYWRELRKIIALKVLSQRRLESLKDVWDSEISSSLNHLHQIWSHQTEPNGKILVEMDQWFGDLTLNVAVKMVAGKRFFSADAACDENESRRCQKAIREFFRLLGQFVVSDSLPFLGWLDLEGYQKEMKSTAKEVDSILQKWLDEHKQKRQSAGADRDQDFMDVMLSLLEDASLSQYDTDTINKATCFSMIVGGSDTTKITLTWALTLLLNNPDVMKKSQDELDIQVGKDRHVEESDIKNLVYLEAIVKETLRLYPAAPLLAPHEATEDCIVAGYNVRAGTRLIVNAWKIQRDPLIWPNPSEFLPERYLNKDVDVKGQHFELIPFGSGRRACPGITFGLQVVSLTLARLLHEFEISIASGIKVDMTESGGLVTAKATPLKALIAPRFLYSHHHI

SEQ ID NO: 174 - protein, 525 aa, Mahonia aquifolium
MNSLQFLATPLLTLIALLCVYCIVWRKSFSRNGSKIKQAPWAGGAWPIMGHLHLLAWGDLPHITLGALADKYGPVFMMQLGMRQAIVVSSAEIARECFTTNDRILATRPSSIAVKLMAYNYAMFAFAPYGPNWREIRKTVMLELLSTPRLESLKHVWEDEISTSVKELYELCASKTKTHGHVSVDMKQRFGDLTLNVLVKLVNGKRYFGANTDYTEHESRRCQKAVRDFFSLMGLFVVSDFLPFLERLDLQGYEKEMKRVAREVDGIVQGWLDEHKRKRESSETTHDQDFMDVMLSILKDSKFSNSDYDADTINKATCFNMILGGSDTTMSTMTWALSALLNNPHMLKKAQDELEFHVGKGRQVEESDIKKLTYLQAIIKETLRLYPSAPLLAPREATEDCKIAGYHVPAGTRLIVNVWKIHRDPFVWPNPNEFQPERFLNKDVDVKGQHFELIPFGSGRRACPGVSLGLQVVSLGLARLLHGFELSIPSGSKVDMTETASLVTFKATPLEVFITPRLSPHMYVE

SEQ ID NO: 175 - protein, 502 aa, Mahonia aquifolium
YAWKRKNHTKDSKIKEPPQPAGAWPIIGHLHLISRGGLPHINMGAMADKYGPVFMIRLGVNRAVIVSNSEIVKECFTTNDKFLLNRPVGLALNLMSYNNAMFGFSRYGPYWREIHKIVMLELLSSSRLESLKHVWDSEILTSIEELYQLCQTQNKAHEGPVLVEMKDWFADMALNVSFRMVAGKRYFGASAGGNKDEARRCQKTMRDFFRLVGLFIVSDALPFLRWLDLGGHQKEMKRTFEDLDYVLQGWLDEHKLNRKSGGNGDQDFMDVMLSTLYDSKFTDYDVDTINKATCFQLILGGTDTTTVTLTWALSLMLNHPHVLKKAQDELDIQVGKHRQVEESDIKNLKYLEAVIKETLRMRPVGPLLGPREAIEDCTIGGYRVRAGTRVMVNAWKVQRDPSVWPNPDDFKPERFLKKDIDFRDQNFEFIPFGSGRRACPGISFAVELLPMALARLLHGFELKTQLGCKVDMTEHAGLVHAKATPLEVLVSPRLSRELYVSS

SEQ ID NO: 176 - protein, 529 aa, Menispermum canadense
MDSTDHHLALVIPTLLATPVLLFSFYCLLLRPRSLKKPRTNKPPEPSGSWPIIGHLHLLSQGLPHITLGAMADKLGPAFSIRLGTRRALVVSSWEVAKECYTTNDRAFASRPSSIAVKLMSYNNSILGFAPYGQYWRELRKIVVLQLLSNRRLESLKNVWESEIDLSIKELYDTWASNRGGEALMVDMKQWFGDLTMNIVVRLVVEKRCFGRSVGDDETEARRGQRALKEFLKLVGLFLVEDAFPFLSWLDVQGHQREMKRIARELDSLFQGWLEEHKRKRSIKGEAKGDQDFMDVMLSVLEDSTISTDIEDDTVIKSTCLTVVLGGSDSTVGTLTWALSLLLNNRHELKKAQDELDAYVGKERQVDESDIKNLVYLQAIVKEVLRLYPAGPLSGPRESVEDTVVAGYHVPKGTQLIVNLWKIQREPSIWADPLEFQPERFLTTHKGMDVWGQHFELIPFGSGRRSCPGTAFALQVIHLTLARLLHGFELTTPCGAPVDMSESAGLINVKTTPVEVHVAPRLPLKLYKS

SEQ ID NO: 177 - protein, 529 aa, Menispermum canadense
MILIAMGNHIELQDIILYSLGFFAATILWRIFSTYVLRRNSCSRPPEAAGKLPLIGHLHLLGANKILHHTLGDMADRHGPIFSLNLGIKRTLVITSWEVAKECFTTQDRVFATRPKSLVGKVVGYNSTVMIFQQYGPYWREIRKLAMIELLSNRRLEMLKHVRESEVNLFIKELYEQWSSNENGSKVVVEMKERFGDLTTNIVVRTVAGKKYSGTGVHGNEESRRFQKAMTDFMHLAGLFMVSDALPLLGWIDTFKGYRGKMNKTAEEIDHVLGSWLKEHQQKRKNISINHLDEDFIHVMLSAMDGNQFPDIDTETAIKGTCLSLILGGYDTTSATLTWALSLIVNNHHVLKKAQDEMDKYVGRDRQVKESDVKNLTYLQAIVKETLRLYPAAPLSVQHEAMEDCTVAGCNIPAGTRLVVNLWKMHRDPKVWSDPLEFQPDRFLQKHVNVDIWGQNFELLPFGSGRRSCPGITFAIQVLHLTLAQLLHAFQLGTVFASPIDMTESSGVTNPKATPLQVTLTPRLPPEVY

SEQ ID NO: 178 - protein, 513 aa, Menispermum canadense
MDSTYQLLSALLFILCLYYLVCKPITKTKNDEAPVPAGAWPIMGHLHMLRGPNLPHITLSSMADKHGPAFTIRLGTRRALVVSNSDLAKECFTVNDKAFSTRPSTVATKLMGYNNTMFGFAPYGPYWRELRKIVMTELLSSRRLESLASVWASEIESSVKELFAEWAENRAKGPVVVEMGEWFGNLTLNIALRMVVGKRYLREESRKCLKAMRDYPELFGRFLVEDAVPFLGWLDLIQGYQREMKKTARELDSVLEKWLVEHKDKRGSGEGKGEHQDFMDVMISVLEDSKLSYGEADTVNKSTCLNLILGATDTTMVALTWALSLLLNNKQVLKRAQQELKSQIGNNKQVSQSDIKNLLYLQATVKEALRLYPPEPLSGPREALEDCTVAGYRVRAGTRLIVNLWKIHRDPSIWQVPLEFRPERFLTAHKDVDVWGQHFELMPFGSGRRSCPGISFVLQVVPLILARLLHGFELTTPGEALVDMSESAGLVNAKVTPLEVVISPRLPLELFAG

SEQ ID NO: 179 - protein, 534 aa, Menispermum canadense
MIMMFIDYYSSWLPQTLLLQSILLAVSLVIFINLFLTRRRSYSSKSHTNIIHPPKAAGALPVIGHLYTLFRGLSAGVPLYRQLDAMADRYGPAFIIHLGVYPTLVVTCRELAKECFTTNDQTFATRPSTCAGKYIGYNYAFFGFAPYGPYWREARKIATVELLSNYRLDSLRHVREAEVGRNVDELYALHASSSTNKQNMMKIDMKQWFDQVTLNVILMMVVGKRCVTTGGNEEEVRVVKVLHEFFKHLGTLSVSDVVPYVEWMDLDGNIGRMKSTAKELDCILGRWLEEHRRERRSDFMDAMLAMVEGIKIPYYDSDTVIKAICLNLLNAGSDTLGITMTWALSLLLNNRHVLKKVKDELDVHVGKNRQVEELDVKNLVYLHAVVKETLRLFPPAPLGVPHEAMEDCVVGGFHVAKGTRLVVNVWKLHRDPSVWSDPLAFKPERFLDNNTVDVRGQHFQLLPFGSGRRGCPGITFALQVAHLTLARLLHGFEWDTPDGAPVDMSEVSVLTTAKKNPVEVLFTPRLPAEVYTQN

SEQ ID NO: 180 - protein, 523 aa, Menispermum canadense
YQLLFLQTAIAGLLFALALLVRLRFSRRNNGKKKQAPPEPAGARLIMGHIHMLNSGEQPHKTLAALADQYGPVIKLRLGLRDAIVVSNWEMAKECFTTNDKIFLSRPQTVVSKFMSYNLKMLGFAPYGPYWREIRKIVVSELLSNRRLELLKNAWTSEISSWVKELFDEWGAKEARGPVVVDMRHWFGNLAFNIGMNMVAGKRFFGPRVVSDEDGLRRVQQGLTDFFRLIGAFLLEDAVPFLSWWDSQGYQKEMKDTAREMDTLIQGLLDEHKRRRSSSSGEAKGEKDFMDVMLNILEGSKFPSGDADNINKSTCLSLMLGLTDTTTATLTWALSLLLNDPRVLKKAREELDFHVGKNRLVDTSDLMNLPYIHAIVKEVLRLHPPAPLSGHRESLEDSVVGGYHVPKGTRFMVNVWKIHHDPNKWPDPIEFRPERFLTTHKDVEVWGQNFELIPFSSGRRVCPGASLSLQVLPFTLARVLQGFEVATPGGAPVDVTESKGLSTAKETPLDVVITPRLPEKFYH

SEQ ID NO: 181 - protein, 528 aa, Nandina domestica
MDSLISFQAIVGLFILILVSYQWLGRSRSIKTNKHNEAPEPAGRWPIIGHLHLLGGSDQLLYRTLGSMADKLGPAFNIRLGSRRAFVVNSWEVAKECFTINDKALASRPITVAAKLMGYNYAVFGFAPYSPFWRAMRKIATLELLSNRRLEMLKHVRISEVDMGLKEIYGLWSKNKDSGPLMIELNRWFENLTLNMVVRMVAGKRYFGADASCDENEAQRCQKAISEFFRLIGIFVVSDAIPSLWWLDLQGHEKAMKRTAKDLDSILGGWLEQHRSRRVNGKVPTEGEQDFIDVMLSLQEGDHLSDFEYDADIAIKSTCLALILGGSDTTAGTLTWAISLLLNHPYALKKAQEELDLHVGKDRQVYDQDIKNLVYLQAIIKETLRLYPAGPLLGPREAMEDCTISGFDVRAGTRLVVNVWKIQRDPNVWSNPSEFSPERFLTSHVDVDVRGQNFELMPFGSGRRSCPGASFALQVLHLTLARFLHGFGLANPLGKPVDMNESPGLTIPKATPLNVLLTPRLDSELYGC

SEQ ID NO: 182 - protein, 520 aa, Nandina domestica
METFQFLGIPLFGFFALLCTYYLVLRKPSSTKIREPPRPAGAWPIIGHLHLLARGDLPHVTLGKMADKYGPVFKLKLGVRQAIVVSDWEVAKECYTTNDRALANRPSGLGAKIMGYNYALIGSAPYGPYWRDLRKIITLEVLSSRRLESLKHVWDSEISTSVKELYQIWADQNKAQGQVSVEMKQWFSDMTLNVAVRLAVGKKYLGATADCEKNKAVQCQKAIRNFFRLAGLFVVADYLPFLGWLDLGGHEKEMKHTAKELDYIAQEWLDDHKKKRTSNRTVDEPQDFMDVMLSILEESTFTGYDVDIINKSTCFALILGGTDTVAVTLTWALCLLLNNPHVLKKAQDELDIHVGKDRHVNESDIKNLVYLQAMIKETLRLYPAGPLLGPRQVIEDCTIAGYHVRAGTRVIVNAWKFQRDPSIWSNPCEFQPERFLDKDIDVKGQHFELIPFGAGRRACPGISFALQVLPLALARLLHGFELKNPSESQVDMTETPGMVHAKTTPLEVLITPRLSPKFYV

SEQ ID NO: 183 - protein, 495 aa, Nandina domestica
WKRPTSVKYREAPQPAGAWPIIGHLHLLARGDLHHITLGAMADKYGPAFMMRLGVHQAMVVSDSESAKECSTTNDRVLATRPSSVAVKLMGYNYAMFGFGPYGSYWREIRKIVILEVLSNHRLESLKHVWKSEISMSTKELYQLWINQNKDEGPTLVELKQWLCNMTLNIGVRTVAGKRYFGASSCDANESNRIQRAIRDFFRFVGLFVVSDFLPFLGWLDLEGYQKEMKSIARELDSILQGWLDEHTRKRQSGGTNENQDFMDIMLSVLEHSNALTHYDADTINKATCFTMILGGSDTTMVTLTWALSLLLNNPHVLKKAQDEIDIQVGKDRLVDESDIKNLVYLQAIVKETLRLYPAVPIITPHEAIEDCTIAGYHVPAGTRLIVNAWKIQRDPLIWDNPGEFQPERFLYKDVDVKGKHFELIPFGSGRRVCPGISLALQVVSLAMAHLLHEFDLAKPSEGNVDMTESVGLVNAKATPLEVLITPRLSPKFYE

SEQ ID NO: 184 - protein, 525 aa, Nigella sativa
MGSFNQINPSVVYFAAFTIFFFFFLYKILYKRRTSAKTRVAPEPAGAWPFIGHLPLLSQQNLPHVTLGVLADKYGPAFTVQLGLHKAVVVSSWEVAKECFTVNDKVLATRPSSVAVKIMCYNYAVFGFGPYGSYWREARKIVVRELLSNHRLNLLKHVLVTEISMSMNELYTVWQKNANNVSGKALVEMKQWFGDLSLNMIVKIVAGKRYFQASANSDERDQLKRGVQDLFHLVGLFLVSDALPFLSWLDIGGHEKAMRRTAKELDNILGSWLDEHKQAKLAGATKGEQDFMDVLMSILEDNNNLPEYEPDVVSKAICLGMILGGADTTTITLTWIVSLLLNNQHILKKAQDEIDSKVGKDRQVNESDIEKLVYLQAIVKETLRLYPPAPLSTQHEAMEDCTIAGYHVQAGTRLITNIWKIQRDPGVWPNPCEFQPERFLTTHANVESNGKHFEFIPFGSGRRACPGMSLGLQVVHLTLARLLQGFELETPLSVEVDMTESAGLTNLKVTPLEVLINPRLPSNLY

SEQ ID NO: 185 - protein, 517 aa, Nigella sativa
MDLTSILICIFLFIISICFLSWKRSRSLSGTRAAPEPVGAWPVIGHLRLLMGSKTPHMTLGNLADNYGPAFTIRLGTKKTLVVSSWEVAKECLTTNDKAFAGRHSTMAVEIMGYNYAFFSLGPSGQYWREIRKITVSELLSNRRLELLKHIWSSEIKTSIKELYEICAAQSQYGKKQSPMVEMQQWFSHLNLNLSARMVVGKRYFADGVEENEGDIRRFQNAIKEFFYWAGAFIIADTIPYLRWMDFLNERSMKRTAKETDHVLEGWLQEHKRNRLNGVTKEQDFMDVLLTELGDKDLCGYTADVVNKATCLNMIFGGTDTTKTGMIWTLSLILNNPQVLKKLQNEIDIQVGKDRQVDDSDIGNLVYLQATVKEAMRLYPPATIFGRESIEDCTVAGYHIQAGTRLIVNAWKIQRDPNVWPNPDEFQPERFLTNQADVDFRGQDFELIPFGAGRRACPGISLTVRVTHLTLACLLQGFNFETPLNEPVDMSEKYGLTNSKATPLNVILTPRLPSNLY

SEQ ID NO: 186 - protein, 530 aa, Nigella sativa
MDSIFHMYAPINILAATFVFIVISVWFLLWMKRSRKNSKSRRAPEPVGGWPLIGHLRLLVGPELPHVILGSLADKYGPALSIRLGMRQALVVSNCEVVKECLTTNDRCFSTRPSSVAVELMGYNYASFGLGPYGGFWREVRKIAILELLSNHRLKSLKHVWISEISGFVKELYQLCVANGNTGRQSALVEMRQWLNDLTLNVSVRMVVGKRYFGSGSEHGGEDVKRFQKAIKDFFRLAGKFTLADAIPFLRWLDFGHERAMKKTAKELDYVLARWLDQHQKNKLNCETKQVDQDFMDVMLTVLGDKDLYGFKADVVNKATCLNLILGGVDTTSVTLTWALSLLLNNPNILNKAQEEIDVQIGKDRQVDDNDLGKLVYLEAIVKETMRLYPAGPLSGARAAIEDCMVAGYHVPKGTRLIVNTWKIQRDPEKWDNPSEFRPERFLITTTNGHVEVWGQHFEYIPFGSGRRICPAISFSLQLVHLTLARLLQAFSFQTPSNAAVDMTETPGLVNFKATPLQILLTPRLPSSLY

SEQ ID NO: 187 - protein, 527 aa, Nigella sativa
MLSIHDSTMVFLQLQAICGIFGFIFIITWWTRWKSSNKMKAPEVAGAWPVIGHLHLLGGGRPLYQLLGDMSDKYGPAFTLRMGIQKALVVSSWEVAKECLTTNDRALATRPSSAGGKYMGYNNALIPFSPYGPYWRDMRKIATLELLSNHRLEELKHVREMEINTCISDMYKLCQVEDGVEIKPISVDLSQWFADLTFNVVVMMITGKRYIGSTDAGDMNEIRHFQAALVKFMRLLRISLLVDVFPVLQWINYGGFKGVMKSTARDIDSVLENWLQEHQRKRLSPDFNGNHDFIDVMISTLEGTEFSDYDHNTIIKAISMAMVVGGTDTTTTTLIWAISLLLNNPNAMKKVQEELEIHVGKERNVDGSDIQHLVYLQAVVKETLRLYPPVPLSVMHQAMEDCVIGSYNIQAGTRVLFNLWKLHRDSSVWSDPLEFRPERFLTSHVDVDVRGQHFELIPFGSGRRSCPGISFALQVIHLTIARLFHGFNLTTPGNSSVDMSEISGATLSKVTPLEVLVTPRLSSKLYN

SEQ ID NO: 188 - protein, 520 aa, Nigella sativa
MDFLIYVAAFAAAFFFLLFYNILSKRITGTKRRIAPEPAGAWPFIGHLPMLFGPNLPHVTLGALADKYGPAFTIQLGLHKALVVSSWEVAKDCFTVNDKALATRPTSAAVKIMAYNCAVFSFSPYGSYWREARKIAILELLSHHRLDLLKHVRKSEVSTSIRELYQFWQKNATEVTKFAQLEMKQWFGDLTMNLIVRMVAGKRYASVQSDDDGEGKRLQKAVNDFFHLVGLFVVSDALPFLGWLDIGGNLKTMKKTARELDSIMECWLKHQARRSNGEQDFLDVMLSILREDNKLQEYDGDVVVKAMCLNMILGGADSTTITLTWTISLLLNNRHILQKAQDEIDSKVGKDRQVNESDIEKLVYLQAIVKETLRLYPPAPLSSQHEAIEDCTIAGYHIPAGTRLITNLWKIQHDPSVWHNPSEFQPERFLTTQANVDFRGQNFEFIPFGFGRRSCPGTSLGLQMVHLPLARLLQGFTFETPSNAAVDMTESAGLTNHKVTPLEVLISPRLRFDLYQESPP

SEQ ID NO: 189 - protein, 525 aa, Nigella sativa
SFNQTYTGFICLSVFASFFFFFLYSVQQKRRTGRKARYAPEPTGAWPLIGHLPILFEPNLPHIQLGALADKYGPVFSIKLGLRKALVVSSWEVVKECFTVKDKVLASRPSSVAVKIMGYDYAVYAFGPYGSYWREARKLTILELLSDHRLDLLKHVRVSEVSMSMKELLKFCQKNANNVSGKALLVDMKQWFGDLTLNVIVRMVAGKSYLGASAKLEDGEQKRLQNAIHEFFRLAGLFVVSDALPILSWLDIGGHEKAMRRNAREIDKIMSSWLDEHRRNKLAGVTNGEQDFMDVLLSKFENSNLPGYEPDVAIKAICLNMILGAADTTIVTLTWVVSLILNNRQILKKAREEIENKVGKDRQVNESDIEKLVYLQAIVKETLRLYPAAPLSAHHESMEDCTIAGYHVPAGTQLITNLWKIQRDPRVWPNPCEFLPERFLTTHANVNYKGQNFEFIPFGYGRRSCPGMSFGLQMVHLVLASLLQGFELETPLNEAVDMTESAGLTNLKATPLEVLITPRMPLNLY

SEQ ID NO: 190 - protein, 509 aa, Nigella sativa
VTVIYLFTFAIFFYLYSILWKNPRKSAKTRVAPEPAGAWPFMGHLPMLLEPNLPHIKLGALADKYGPAFTVQLGLHKALVVSSWEVAKECFTVNDKVLADRPSSVAVKIMGYDNAVFAFGPYGSYWREARKISTVELLSNHRLSLLQHFRISEASMSMKELYQLCANNGKALVEMKKWFGDLSLNVIVRMVAGKRYAKASEDDERRQLQKGLKDFFYLVGLFVVSDALPILSWLDIGGHEKAMRRTAKELDTIMERWLDEHRRAKLAGVTKGEQDFMDVLLSILEDGKLPHYESNTVNKAICLTMILGAAHTTTVTLIWTLSLLLNNRHILNKAQDEIDSEVGKDRAVTESDIKNLVYLQAIVKETLRLYPAAPLPAHREVMEDCIIAGYHVPVGTRIITNLWKIQRDPRVWSNPCAFQPERFLTTHSNVDFRGQNFEFIPFGSGRRSCPGISLGLQMVHLALARLLQGFELETPLNLGIDMTESSGLTNLKVTPLEVVITPRLPSNLY

SEQ ID NO: 191 - protein, 562 aa, Papaver bracteatum
MAYLMIKKSFHLFSDQPTSVSTLIVLAFLLTLSPVIIYYEQKKRGLRRNRTSSSCTAITTTPLPEASGAWPVIGHLLLFMNENDLNHATLGNMADKYGPIFSLRFGSHRTLVVSSWEMVKECFTGANDKFFSNRPSSLAVKLMFYDTESYGFAPYGKYWRELRKISTHKLLSNQQLDKFKHLRISEVDNSFKKLHDLCSNNKLGGETTSVANLVRMDDWFAYLTFNVIGRIVSGFQSNAVSGATSSQEKYKLAIDEVSNLMATFAVSDVVPCLGWIDRLTGLTGKMKKCGKKLDAVVGDAVEVHRQKKLKISRNTAGELTEHEEEDFIDVCLSIMEQSQIPGNNPEISVKSIALDMLSGGSDTTKLIMTWTLSLLLNHPDILDKAKEEVDTYFRKKKISDNTPVVDAADVPNLVYIQAIIKESMRLYPASTLMERMTSDDCEVGGFHVPAGTRLWVNVWKMQRDPRVWNDPLVFRPERFLSNDKGMVDVKGQNYELIPFGTGRRICPGASFALEVLHLVLTRLILEFEMKAPEGEIDMRARPGFFNNKVVPLDVLLTPRTLD

SEQ ID NO: 192 - protein, 519 aa, Papaver bracteatum
MNNYSSSPASSTETAVLCHQRQQSCALPISGLLHIFMNKNGLIHVTLGNMADKYGPIFSFPTGSHRILVVSSWEMVKECFTGNNDTFFSNRPIPLAFKIIFYAGGVDSYGLALVPYGKYWRELRKICVHNLLSNQQLLKFRHLIISQVDTSFNKLYELCKNSEDNQGMVRMDDWLAQLSFSVIGRIVCGFQSDPKTGAPSRVEQFKEAINEASYFMSTSPVSDNVPMLGWIDQLTGLTRNMTHCGKKLDLVVESIINDHRQKRRFSRTKGGDEKDDEQDDFIDICLSIMEQPQLPGNNNPPKIPIKSIVLDMIGGGTDTTKLTTIWTLSLLLNNPHVLDKAKQEVDAHFLTKRRSTNDAAVVDFDDIRNLVYIQAIIKESMRLYPASPVVERLSGEDCVVGGFHVPAGTRLWVNVWKMQRDPNVWADPMVFRPERFLSDEQKMVDVRGQNYELLPFGAGRRICPGVSFSLDLMQLVLTRLILEFEMKSPGGEVDMTATPGLMSYKVLPLDVLLTHLSAS

SEQ ID NO: 193 - protein, 540 aa, Papaver bracteatum
MEFLMKLLLLLEPITFSIFLGIGSIVLLYNVFFLVINKKKKKKAPNASGAWPLIGHLNLFMNDKEALYKTLGTMADKYGPAFNVRLGNQEILVVSNWKMVKECFNTQNDKLFSNRRTTLGVKYMLNKKTSVAFSPYGTYWRELRKLTVQQLLSKQRLDSWKHLKIKEIDASFGRLNDLCSNNKGTGAATPIRMDSWFAELTFNVFARIVFGYQSGERLMLSGDTASNGERYKKTLEEAFLLMSSFAVSDVFPCLEWVDRSRGLVRSMKRFGDQLNSIAGCLIEEHRQKRSQSVSASNSTNDKGVGDEQDFIDVLLSVAELSQIPGDDPDLVIKSMILEALAGGSDTTTSTLTWVLSLLLNHPKVLKTAKEEIDMHVGRNRCVEESDIPKLVYVNAIIKESMRLYPNGSLVDRLTLEECEVGGFHVPAEGHLFVNVWKIHRDPSVWENPLEFKPERFLSNDCKVDMDFISQKYEFIPFGIGRRICPGMLSALQVMHFVVARLIHGFDMEAASADGKVDMAEKPGMTCYKMTPLEVMLTARQ

SEQ ID NO: 194 - protein, 548 aa, Papaver bracteatum
MYPVNQLQSQAIAVLCAVIVFIFYLGRKLFNSTHIHKPGKTAPEPAGAWPIIGHLHLLGGAKLMYRTLGSLADEYGPVFMVRLGMRRVLVISNTASARECFTTNDKVFATRPTTVAIKLLTYNHTMFGFAPYGPYWREIRKIATTELLSDRRLAMLKNVWISEINLCINELHQLLMDKNSRKVDHHQHVYNQNMDPISVEMNGWFADLSFNVVARMIAGKRYFGKNTDGGEEETRRYREAMNDFMHLVVILLVSDAVPFLGGLDFQGYKKRMKKTAKEIDYFLGKWVDEHRQRLKYKNISKVDQQDDFIDVLLLNLNDQPIYGRDTDTIIKSTCLSLIAGGSDTTAVTLTWALSLLLNNQHVLRKAQDELDIHVGRERQLEESDIKNLVYLQAIVKETLRLYPAAPLSAPRMAMEDCTVAGFQVSKGTQLMLNVWKLHRDPHFWGPDPLEFRPERFLTADGSSTGSGHCIDIDVKGRHYELLPFGSGRRMCPGVSFAMQVVHLTLATLLHGFHLSTPTDGPVDMTETSGLSCPKATPLEVLLTPRLPC

SEQ ID NO: 195 - protein, 567 aa, Papaver bracteatum
MDVAIIVDHHYLQPFVSIAGLLALLSFFYCIWVFIIRPRIIKSNLDERKLSPSSPPEVAGAWPIVGHLPQLIGSTPLFKILADMSNKYGPIFMVRFGMYPTLVVSSWEMSKECFTTNDRLFATRPPSAAGKYLTKALFAFSVYGPYWREIRKISTIHLLSLRRLELLKHGRYLEIDKCMKRLFEYWMEHHKNIISTTSSVKVNMSQVFAELSLNVVLKIIVGKTLFIKNGNEDYTKEEEEGQKLHKTILKFMELAGVSVASDVLPFLGWLDVDGQKKQMKRVYKEMNLIASKWLGEHRERKRLQIIQKRGAARGSNYDDGNDFMDVLMSILDEENDDLFFGYSRDTVIKSTCLQLIVAASDTTSLAMTWALSLLLTNPNVLQKAQDELDTKVGRDRIIEEHDIECLVYLQAIVKETLRLYPPAPLSLPHEAMEDCTVGGYQVKAGTRLVVNLWKLQRDPRVWSNPLEFKPERFLPQSDGGFGGEEARMDFRGQHFEYTPFGSGRRICPGIDFFLQTVHMALARLLQAFDFNTAGGLVIDMVEGPGLTMPKVTPLEVHLNPRLPVTLY

SEQ ID NO: 196 - protein, 558 aa, Papaver bracteatum
MQVDWPNILQKYYPIITCSLLTLLSFYYIWVSITKPSRNSKTKLPPPEVAGSWPIVGHLPQLVGSTPLFKILANMSDKYGPIFMVRFGMHPTLVVSSWEMSKECFTTNDKFLASRPPSASAKYLGYDNAMFVFSDYGPYWREIRKISTLQLLTHKRLDSLKNIPYLEINSCVKTLYTRWAKTQSQIKQNVGGAADDFVKVDMTEMFGHLNLNVVLRLVVGKPIFIQKDNADEDYTKDGHNKEELGQKLHKTIIEFFELAGASVASDVLPYLGWLDVDGQKKRMKKIAMEMDLFAQKWLEEHRQKGINHDNENDFMAVLISVLGEGKDDHIFGYSRDTVIKATCLTLIVAATDTTLVSLTWALSLLLTNPRVLSKAQDELDTVVGKERNVEDRDVNHLVYLQAVIKETLRLYPPSPLAVPHEAIENCNVGGYEVKARTRLLVNLWKIHRDPRVWSNPLEFKPERFLPKLDGGTGEASKLDFKGQDFVYTPFGSGRRMCPGINFASQTLHMTLARLLHAFDFDIESNGLVIDMTEGSGLTMPKVTPLQVHLRPRLPATLY

SEQ ID NO: 197 - protein, 571 aa, Papaver bracteatum
MMDLAMFIDQYFSLAKIAGLLALLSFFYYLWISTLWSPRNPKLSSVSPPEVAGAWPILGHLPQLLGSRPLFKILADMSDNYGPIFMVRFGMHPTLVVSSWEMAKECFTTNDRFLAGRPSGAANKYLTFALFGFSTYGPYWREIRKIATLHLLSHRRLELLKHVPDLEVTNCMKHLHRRWIDSQNQIKQNDAAAGSVKVDMGRVFGELTLNVVLKLVAGKSIFFKNDNTRQYDSKDGHNKEEEEGKKLHKTIIDFYSLAGASVASDVLPFLGWLDVDGQKKRMKRVAKDMDFIAAKWLEEHRHQKRQTVLSSSATLGSSNHDDAKDFMDVLMSILDGENDDLFFGYSRDTVIKTTCLQLIAAAADTTSVTMTWALALLITNPTILRKAQDELDTKVGKDRNIEERDINDLVYLQAIVKETLRMYPAGPLNVPHEAIADCNIGGYEVRAGTRLLVNLWKMHRDPRVWSNPSEFKPERFLPQLDGGSGGEAANLDFRGQDFEYLPFSAGRRMCPGIDFSLQTLHMTLARLLHGFDFNNDSAGIIIDMEEGSGLTMPKLTPLEIYLCPRLPAKLY

SEQ ID NO: 198 - protein, 543 aa, Sanguinaria canadensis
MEFLSLQFQPITIFALLLATPIFLYNLWNYGRKLNNKNKKSRKPPAPEASGGWPIMGHFHLFNGTEVTHRALGSMADKYGPAFNIRIGSHPTLVVSSWEIAKECFTTNDRLFSNRPGSLAIKLMFYDADSVGYAPYGTYWRELRKISTLKLLSNHRLETLKHLRTSEVESCFKQLHDLWRMNNKKGGSDDGSDFALVRIDNWFGDLTFNVVARIVAGKKNFAGGAASGDAGAQRYKEAMDEAFRLMTRFAFSDVVPSLGWLDKLTGLVGGMKRCGSEIDSIVASWVDEHRLKRISGKEGDDLEQDFIDVCLEILEHSTLPGDDPEVVIKSTCLDMILGGSDTTTVTLTWALSLLLDHPHVWKRAKEEVDAHVGKERQVEDSDIPNLVFIQAIVKETMRLYPAGPLIERRTMDDCEVGGFHIPGGTRLIVNLWKIQRDGSVYKEDPLEFRPERFLTSNAEVDLKGQNYELIPFGAGRRICPGVSFAVQLMHLVLARLIHDFEITMPMGAKVDMTESGGLISHKVTPLEVLLKPRLPSLQQAALY

SEQ ID NO: 199 - protein, 525 aa, Sanguinaria canadensis
MEYSSVLLHWFPASMAALLALVFLYNLIFNSPKTGNKKIIRRAPKAAGAWPVLGHLHLFGSGELPHKMLAAMAEKYGPAFTMKFGKHTTLVVSDTRVVKECFTTNDTLFANRPSTKAFDLMTYANDSVAFTPYSPYWRELRKISTLKLLSNHRLQSIKEVRVSEVSVCFRELYDICKNDGGGAPPVLVDMKKWFEEVSNNIVMRVIVGKQNFGSKIVCGEEEAVNYKNVMDELLRLASVSMLSDVAPLLGWLDMFQGHMSAMRRNGKKLDTILERWLEEHRKKKSEDEQDFMDVMLSIVEETKLSGRDADTVIKATCLAMIMGGTDTTAVSLTWIVSLLMNNRYALKKAREELDALVGKDRQVEDSDLKNLVYLNAVVKETMRLYPLGTLLERDTKEDCEVGGFHVEGGTRLLVNVWKLQRDPNVWNDPLEFRPERFLTENADIDVGGQHFELLPFGAGRRVCPGVSFALQFMHLVLARLIHGYELGTQNDEDVDLTESTEGHVNHKASPLDLLITPRLHPKLYE

SEQ ID NO: 200 - protein, 527 aa, Sanguinaria canadensis
MDYSSHLNQFYGVAPYMAALLIALVFLYNILWASPKTTNKKPIMAAGAWPILGHLHLFKDGELPHHMLKSMSDKYGPAFLMKFGQHRTLVVSNYRMVKECFTTNDTHFCNRPSTTAFDVMTYANDSVAFTAYSPYWRELRKISTLKLLSNNRLQAIKNLREAEVNVSFRGLYDLWKNNSDRAASVLVDMKKWFEEVSNNVVIRVIVGKHNFGTKIVKGEKEAVEYKTIMDELLRLASLSLLSDFAPILGWVDFFQGNVRKMKRNGKKLDVVLQRWLETHRRKKNSPEDEQDFMDVMLSIVEEGDKLSGHHADTVIKATCLAMIMGGTDTSAVSLTWIVSLLMNNRHALKKAREELDMYVGKDRQVEDSDLKDLVYLHAIVKETMRLYPLGTLLERETKEDCKVGGFHVEAGTRLLVNIWMVQRDPTVWSDPTKFIPERFLTEKADIDVGGQHFELIPFGAGRRVCPAVSFALQFLHLILARLIHGYELGTPNDADVDLTESPEGHVNHKASPLELLLTPRLDPKLYI

SEQ ID NO: 201 - protein, 535 aa, Sanguinaria canadensis
MNSIAVVGVLLFFLYYLWRTLFTTHKAAPPPQPAGARPIIGHLHLLGGANQLVHQTLGSMADKYGSIFMIRLGMRRVLVVSSSELAKECFTTNDKVFLNRPSSLALKLMAYNNAIFGFAPFGPYWRKMRKIAVTELLSNRRLEILKNIRISEINMSIKELHQLWVDMNSGDDQVGGPPIVVEMRKWFGDLSFNVVGRMIAGKRYFGRNCDCDEEETRRYQKAMGDFMHLVGVFVVSDAIPLLGFLDLQGYEKKMKRTAMDIDCVLGRWVDEHRRRRQDHDEKRIMVSDDDHQGQDFIDVMLSILNDDDQFYGYDADTVIKSTCLSLIAGGHETTAVTLTWALSLLLNNRHVLQNAQDELDIHISKERQVDESDIKNLKYLQAIVKEALRLYPALPLSALRLAMEDCTIAGFHVPKGTELMLNLWKLHRDPHVWSDPLEFKPERFLTNSTHEEVDVGGQHYELLPFGSGRRMCPGVSFALQVLHLTLARLLHGFHLSTPSGVPVDMTQSFGLSCPKATPLDVLLTPRLPSKLYYVA

SEQ ID NO: 202 - protein, 601 aa, Sanguinaria canadensis
MISTTPDVLATSSYSSSNKHMDSDHLYRFSTSTSIVIGLFILLFFLVLLWKPKKQSATSKTNKPTREQRAPEPSSSWPIIGHLRLFGGPNSLPHITLGAMADKYGPVFTIRMGSRPVLVVSSWETAKECFTTNDRVFASRPRTIAIKHMCYEHVMLGFAPYGSYWRELRKIVNRELLSNNRLELLKHVWGSEINTSIKELYELWLVNKNNIEAEGENEGTSDRVLVEMERWFADLTLNMSIKIVVGKRYPSGVTAGGSSGCDDDEAQRCRKALRDFFKLVGLFLVSDAIPFLRWLDLGGYEREMKTTARELDCLMEEWLEEHKMKRRLLISPSAGDHHEAAEIMINKQKEAELQEYDFMDVMLSILDDDIEGKNLSDYDVNADTINKSTCLNLILGGSDTTMVTLTWALALLLNNPHVLQKAQDELDIHVGSKRQVDDSDMKNLIYLQAIVKETMRLYPAGPLSVPHESTEDCTVAGYHVPAGTRLIVNTWKIQRDPRVWSNPSEFKPERFLTDSHVDIDVRGRNFELIPFGSGRRSCPGTSFALQVVHLVLARLIHGFEFKTPSEAPIDMTESVGLSNFKATPLDVLLTPRLPSQLYYVS

SEQ ID NO: 203 - protein, 525 aa, Sanguinaria canadensis
MDSTLVFIGLFALLLVYPLLLRRSVLKSTSNTNKTTYKSKNQAPEAAGAWPIIGNLHQLAGGGNCLHKTLGAMADKHGPAFTIRMGLHKALVVSSWELAKECFTTNDVVFMSRPHQVAIKHMGYSTAMFGIAPYGPYYREMRKIVTQELLSNRRLELLKHVWASEINNSIKQLYEKVEGGPVLIEMKRWFADLTLRTTVKVICGQQQFGGDDDDDEAGRFQTALRDFFRLLGHFRVADVIPVLEWLDFQGYKKEMENNGRVLDNLMNKWLEEHKRKRKNGGTEEDFMNVMISKLLDDTKMLSYYDADTINKSTCLTLILGGSDTTMVSLTWALSLLVNHPHVLKKAQEELDVHVGKERQVDDSDLWSLTYLQAIIKETLRLYPPGPLSAPRESTDNCTIAGYHVPAGTRLIVNTWKIQRDPRVWPDPLEFKPERFLTTHVDVDVKGQNFELLPFGSGRRACPGASFALRVLRLSLARLIHGFDFKTPLDDSPIDMVESGGITNVKDTPLEVLVTPRLPSSLYVCK

SEQ ID NO: 204 - protein, 532 aa, Sanguinaria canadensis
MDFDLYQFSKPTIFIGGLFAILLYFVLKKSSTPKSKSKLEQPPEPAGAWPIIGHLPLLGGPDLPHITLGKLADKYGPAFTIRIGVHKAVVINSWEVAKECFTTNDKAFSSRPRQVAMKHMGYDYAMFGFAPYGNYWRELRKIVNREVLSHSRIESLYHVWGTEINTSVKELYELWGKKSTGSGGAPVLVEMKRWFSDMTLNMSVMMVAGKRYNFSGNKADDEAGRCQDGLRNFFRLVGLFVPSDALPFLAWLDIGGYEKEMKKVAKELDVLVQEWLEEHKEKRLALTAAGKKGSENDFMDVMMNILEDQKLSEFDADTINKATCLTLILGGTDTNMVNLVWALTLLVNNQDALKKAHDELDFHVGKDRQVEESDVKNLVYIQAIMKETLRLYSGPLSGLRESTEDCTVAGYYVPAGTRLIINAAKIHRDPRVWSDPTAFKPDRFLTEQKEMDVRGQDFEILPFGAGRRICPGVSFALQVLPLALARLIHGFDFKTPTDAPIDMTESPGLTNAKSTPLEVLVSPRLTSKLYGC

SEQ ID NO: 205 - protein, 555 aa, Sanguinaria canadensis
MDSILNQFISKPTMVICSLFALLSLYFLLIKRSTTKSKLQLPPEPAGAWPVIGHLHQLGGPNLPHITLAAMADKYGPIFTMKIGTYRALVVSSPEVAKEIFTTHDRIWATRPNQAAMKHLGYDSAMFGFAPYGPYWRELRKLVNRELLSNTRLDLLHHVWDSEINTSIKELYDSLATKNNAKGRGTGGAGSTGPVLVEMKRWFADLTLNITVRMVAGKRYFGANKTSSTSTDQCDNEKGDSKAWKCQRELRNFFRLVGLFVVSDALPFLGWLDLGGHEREMKNTARELDVLVQGWLDEHKRKRSLSVAEGGEKINGEQDFMDMMLSTIDDAKLSGYFDADTINKSTCLNLILGGSDTMMVNLIWPLTLLVNYPDELKKVYDELDTHVGRDRQVDESDIKNLVHLKAVIKETMRLYTGRITGLRQSSEDCTVAGYHVPAGTRLIVNTWKISRDPRYWSDPLEFKPERFLTTHADIELTGQNFELIPFGSGRRSCPGASFAIQLLHLALARLVHGFWFERPSDAPIDTSECPGLTNFKATPLEVLATPRLPSKLYVG

SEQ ID NO: 206 - protein, 538 aa, Sanguinaria canadensis
MDFILNQFISKPTMVLGTLFALLSLYFLLIKRSTTKSKLQLPPEPAGALPIIGHLHLLGGPNPPHITLANMAEKYGPIFSIKMGLKRALIVSSSEVTKECFTTHDLNFVSRPRHAAMKLMGYNFATFGFAPYGPYWRELRMIINRELLSQTRILSLEHVWGSEINESIKELYDLLTRKGGGGGGPVVVEMKRWFADLTLNIAVKMVCGKRYFGVNSPSTSTTRDVQEDDEARRCQKGMRNFFRLLGQFVVSDSIPFLGWLDLGGYQREMKNTARELDDLMQGWLEEHKKKRLERKTAAGEQDFMDVMLNILEDGKLSQYFDTDTINKSTCLSLILGGSDTTMVNLVWAFSLLVKHQDALKKTRDELDIHVGRERQVEESDIKNLVFLQAVVKETFRLYAGPISGVREAAEDCTIAGYHVPAGTRLLINSWKIHRDPRVWSDPLEFHPERYLEARHADIDVKGQNFELAPFGMGRRVCPGSAFGLQVLHLTLARLIHGFEFKTPSDAPVDMTESVGMSIIKATPLEVLVTPRLPSELYV

SEQ ID NO: 207 - protein, 533 aa, Sanguinaria canadensis
MDISNLYELYYFSTPTLFVGGLFVLLLIYSLFSSRPGIKSKLQQPPEPAGAWPLIGHLPVLSGPELPHVALGKLADKYGPVFTIRMGVHKSLVVSDWEVIKECFTTHDKVFSSRPCQVAMKLMGTAMFGFSPYGNYWRELRKIMNREVLSHGRIESLYHVWGSEINTSVKELYDLWAKKNNGGGPILVEMKRWFSDLTLNMSVMMAAGKRYNFGDDSSTTNDEAARCQHALREFFRLVGLFVPSDALPYLGWLDIGGYQKQMKKVARELDDLMQVWLDEHKKKRLAAKAEGKKGGEQDFMDVMMTILEDGKLSDYYDADTINKATCLTLILGGTDTNMLSLVWTLALLMNNRQALKKVHEELDIHVGRERQVEESDIKNLVYLQAVIKEEMRLYSGPLSGLRETTEDCTIAGYHIPAGTRLIINASKLHRDPKVWSDPLEFKPERFLTENVGVDVRGQNLELQPFGAGRRICPGVSFALQVLPLTLARLIHGFELNTPGDAPIDMTESPGLQNAKLTPLEVLITPRLPSKLYV

SEQ ID NO: 208 - protein, 535 aa, Sanguinaria canadensis
MIVIGAFLALVVLVVYYNLLLRRPALLKFKNMKQQAPEAASAWPIIGHLHNLAGGIGGNGLLHEKLGAMADKHGPAFIIRLGLHKALVVSSWEVVKECFTTNDVALISRPHQVASKHMGYGMAMFAFASPYGPYWRELRKIVKQELLSNSRLELLKHVWASEINTSIKQLYEKVKEGGGLPVLVEMKGWFADLTLKMTVKVICGKRHFRVAGNVGDHVDADDDDEVIGGRFEKALRDFFRLLGDIRVVDVLPFLRWLDFGVGYKKEMENNGRVLDILMEEWLQEHKRKRMNGGTEEDFMNVMISKLLNDTKLLSYYDADTINKSTCLTLILGASDTTMVTLTWALSLLVNHPQVLKRAQDELDVHVGRERQVEDSDIQNLTYLQAIIKETLRICPPGPIQAPHEAKDDCTVAGYHVPAGTRLIVNTWKIQRDPRVWPNPSEFKPERFLTTHVGVDVRGHNFELIPFGSGRRSCPGTSFALQVVHLTLARFIHGFEFKTPSDAPIDMTESGRITNVKATPLEVLVTPRIPPSGLYV

SEQ ID NO: 209 - protein, 572 aa, Sanguinaria canadensis
MDLLIFSSQLQGTVGLLALLTFSYYVWILIIKRIKTTNTLKVMNKVAAAAAPEVAGAWPIVGHLPQLVGPQQLYRILGDMADEYGPIFMVRFGMYPTLVVSSWEMIKECFTTNDRFLASRPSSAAGKYLTYDFAMFGFSFYGPYWREIRKISTLELLSHRRLELFKNVPFTEIDTCIKRLYQLWRVKNNDHPAAAPVIKVDMSQLLRDLTLNTILKLVVGKNLFNEKDHGEQEEGRKLHLHKTIVEFFKLAGVSVASDALPFLGWLDLDGQKKKMKRIAKEIDLIAERWLQEHQEKKSLSNKKLLAAGGGKVDGHDDFMDVLLFILDDDSQFFNFSRDTVIKATSWAMILTAADTTSVSMTWALTLLLTNPRVLRKAQDELDMKVGRDRHVEERDIENLIYLQAIVKETLRLYPAAPLGVPHEAIQDCTVAGYQVRAGTRVLVNLWKLHRDPRVWSNPSEFRPERFLIDDIDEQGGGGGGGGGESTAKDFRGQHFEYIPFGSGRRMCPGINFALQIVHMTLARLLHAFELRTTTSASLMDMTEESGLTMPKKTPLVVLLQPRLPLPLYDHHE

SEQ ID NO: 210 - protein, 533 aa, Stylophorum diphyllum
MEFLSLQHQLISIFALLLASIFLYNLLKNHGRKSKTSKPPAPEASGGWPIMGHLNLFNGSELTHQALGSMADKYGPAFNIRFGSHQTLVVSSSEIVKECFTTNDRFFSNRPGSLAIKLMFYNADSVGYAPYGAYWRDLRKISTLKLLSNHRLETLKHLRTSEVESCFKQLYNQWKNNKVGGDHDFALVRMDNWFGDLTFNVVARIVAGKKNFAGGATNGDVGAQRYKEAMDEAFRLMTIFAFSDVVPSLGWLDKLRGLVGGMKRCGAEIDSIVAGWVDEHRLKRASGKGGGHTDLEQDFIDVCLEIMEHSTLPGDDPEIVIKSTCLDMILGGSDTTTVTLTWALSLLLNNPHVLKRAREELDTHVGKDRQVDDSDMSNLVYIQAIIKETMRLYPAGPLIERRTSEDCEVGGFHVPAGTRLLVNLWKMQRDGSVYKEDPLEFRPERFLTSNADVDLKGQNYELIPFGAGRRICPGVSFAVQLMHLVLARLVHGFEMKTAGDAKVDMTESAGLISHKVTPLEVLLKPCLAIQQAL

SEQ ID NO: 211 - protein, 533 aa, Stylophorum diphyllum
MDSFLLIQWFAASMAALLAFVFLYNLVWSSSRTTKGKNIRKAPMAAGAWPILGHLHLFGSGELPHKMLSTMAEKYGPAFTMKFGKHTTLVVSDTRIVKECFTTHDTLFANRPSTTAFDLMTYANDSVAFTPYGPYWRELRKISTLKLLSNHRLQSIKEIRVSEVNVCFRELYESCKSKTDATPVLVDMKKWFEEVSNNIVMRVIVGRQNFGSKIVQGEDEAVNYKKVMDELLRLASLSMLSDVAPVLGWLDMFQGNKSAMKRNAKKVDTILEGWLEEHRMKKSASGISSAGENDQDFMDVMLSIIEETKLSGRDADTVIKATCLAMIMGGTDTTAVSLTWIVSLLMNHRHVLKKAREELDALVGKDRQVEDSDLKNLVYMNAIVKETMRMYPLGAMLERETKEDCEVGGFQVQGGTRLLVNVWKLQRDPNVWTDPTEFKPERFLNENADIDVGGQHFELLPFGAGRRACPGVSFALQFMHLVLARLIHGYELGTQNDADVDLTESTEGHVNHKASPLDLLLTPRLNNPNLYDY

SEQ ID NO: 212 - protein, 568 aa, Stylophorum diphyllum
MTIGALALLSFIYFLRVSVIKRTKYTNTAVTATNKLENDEDEANHSKRVVAPPEVAGAWPILGHLPQLVGLKQPLFRVLGDMADKYGPIFIVRFGMYPTLVVSSWEMAKECFTTNDRVLASRPASASGKYLTYNYAMFGFTNGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATNPGALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 213 - protein, 527 aa, Stylophorum diphyllum
MAALLPLAFLYNIFLASSSKATSKRTISTKKPPMVAGAWPILGHLHLFKEGELPHQMLKSMADKYGPAFLMKFGQHQSLVVSDYRIVKECFTTNDTLFCNRPSTTAFDVMTYANESVAFTEYSPYWRELRKISTLKLLSNNRLQAIKNLREEEVDVSFKGLYDSWKNKNNKSTAGSVGDERAPVLVDMKKWFEEVSNNVVIRVIVGKCNFGTKIVQGEKEGVEYKTIMDELLRLASLSLLSDFAPILGLLDFFQGHVRTMKRNGKKLDVLLQRWLEEHKRKKSTPEDEQDFMDVMLSIIEESKLSGYDADTVIKATCLAMIMGGTDTSAVSLTWIVSLLMNNRQALKKAREELDAQVGKDRQVEDSDLKNLVYLNAIVKETMRLYPLGTLLERETKEDCEVGGFHLEGGTRLLVNVWMVQRDPDVWTDPTKFIPERFLTEKADIDVGGGNFELIPFGAGRRVCPGVSFALQFLNLVLARLIHGYELGTPEDADVDLTESPEGHVNHKASPLELLLTPRLSNPKLYDY

SEQ ID NO: 214 - protein, 547 aa, Stylophorum diphyllum
MDSDHQLLSYQFSASNMFISLFAFVLYYLLVWRPTKSNLKMKTISSEDKQAPELAGSWPVIGHLHLLHGPNPLHVALGAMADKYGPAFTVRVGVHRTLVVSSWEVAKECFTTNDKVFVSRPRQAAGKHMGYNNAMLRFASDTPYWTQIRKMLKRDLLSNNRIELLNHAWHSEINTSIKELYEMNWSSGEGRRGGIRPPVSVDMKQWLGDLTLNMSVKMIAGKRCFGSGVSACDEGEARRCQKGLKDFVRLMGQIVVSDAIPFLGWLDLDGYEGEMKRAGKELDRLLGGWLEEHKMKRSPGDEASAQKDWMDLMLSVLGDGKLDGYYDADTINKATCLALLQGGSIWTMLTLLWAFALLVNHPHVMKKAHDELDNHVGRERQVEESDIKNLTYLQAIVKEAMRLYSVSMRLLESTADCTVSGYDVPAGTRLIVNTWKIQRDPRVWSDPSEFHPERFLTHRHRDMDLYGQNFEITPFGSGRRSCPGSSLGLQMVQLTIARLLHGFEFKTPSDAPIDMTESVGVENMVKATPIEVLLTPRLLDEVYAFYN

SEQ ID NO: 215 - protein, 561 aa, Stylophorum diphyllum
FCQFQGIVGILLAFLTFLYYLWRASITGLRTKPKHNDFKVTKAAPEADGAWPIVGHFAQFIGPRPLFRILGDMADKYGSIFMVRFGMYPTLVVSSWEMAKECFTTNDRFLASRPASAAGKYLTYDFAMLSFSFYGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATYPLCALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 216 - protein, 522 aa, Tinospora cordifolia
MDLPQPTISTTLLAFFSILLFIICYRLLSTKSDKRSSSSRNKPLDAPGAWPVIGHLHLLNGVIQHEILGTMADKYGPAFTIWLGTRPALVVSNWEVAKECFTTCDKALASRPPSLALKIMGYNDALFAFAPYGQYWRELRKIVMIELLSSRQLDSLKHVWDSEIDSCIEDLYEKCKGHRETVLVNMKQWFADLMMNVVVRMVVGKLNFGKTKEGDDEVAKAHQGQLKAMREFFKWVDVFMIEDAFPILTWLDPQGYQRKMKNIAKDLDSLVQGWLDEHKLKQKTGDNGKKDFMDIMLSAVKDASISDRDDETICKATCLNIILGASDTTTVTLTWTLSLLLNNRHVLRKAQEELQAQVGKHRCVEESDVKNLVYLHAIIKEVLRLYPAVPLLGPRESVADTVVAGYHIPAGTRLIVNLWKIHRDPLNWPDPLEFRPERFLTTHKDTDVWGQNFELTPFGSGRRICPGISFALQVIPLTLARLLHGFELTTPGSAPVDMTESTGLTNLKATPLDVFISPRLVL

SEQ ID NO: 217 - protein, 526 aa, Tinospora cordifolia
MESIPTAINVLLAFVSIYYLLKFRKKIITTTRDIKKIKAPELKGAWPIIGHLHLFRSDDLLHRKLGAMADELGPAFMIRLGMRPALVVSNWQTAKECFTTKDRIFATRPDSVAAKHMGYENLILGFTRYGPYWREVRKIVTLELLSSHRLHLLRHVRISEIDMSIKKLHQLCTSNDNKYSSVVVDLNQWFKALTLNIIVRIIAGKRYYGGDLEDDEESRRWKKALNEFMHLFGIFSVSDAIPQLQGMDVQGHERVMKRTGKDIDVILSKWLEEHRRKKIRVNREGAEKDFIDIMLDLIKENVNISGHDADNVVKATCLALVSAGSDTTMITLTWAVSLLLNNHRVLEKAQAELDNQIGINRVHVEEEDIKNLPYLQAIVKETLRLYPAAPFSLPHEAMEECTVAGFHVPKGTRLITNIWKLQRDPQVWEDPLEFRPERFLTSDRRHVDFRGQHFELIPFGSGRRMCPGISFAIGVLHLTLARLLHEFHLGTPTNAPIDMNENPGITLEKADPLHPLVSPRLTSINY

SEQ ID NO: 218 - protein, 538 aa, Tinospora cordifolia
MDSQLTSFQSKPSAYLIAALLALVSAYYLIIKKKSRATYQDNYGKIRAPEPKGAWPIIGHLLLFKPNDVLYQKLSSLADELGPAFMIRLGMRSALVISNWEIAKECFTTNDRIFATRPKLMASKHMGYGGAEVGVAPYGPYWREVRKIITVELVSNHRLNLLKDVRISEIDMSLKELYDLCMKKKKNGSGEESSRVELDLYQWFKDMSLNILVKLIAGKRYYGVAAAANEDEESRRWKKATEESVFLFGQFVVGDAIPLLEGVDVQGLERAMKKTGKEIDAVLSKWVEEHRMKKQQLNGARDEQDFIDVMLNIIKDGKISDHDADTIVKATCMSLVQAGSDTTMLTLTWAVCLLLNNCNVLEKAQAELDDQIGRSKGRIVEEDDIKKLPYLQAIVKETWRLYPPAPLAVPREAMEDCTVAGFHVPKGTRLMTNIWKLHRDPKVWDDSLKFRPERFLSSEHAHVDFRGQQHEFMPFGSGRRMCLGMPLAIGVVHLTLARLLHEFELATPSNAPVDMSEKAGLTLVKATPLNVLIAPRLC

SEQ ID NO: 219 - protein, 531 aa, Tinospora cordifolia
MDSIILQSNLLTTVIIITSFGLFVLSFYYVLWKAIRTGNKRNCSNPKAPEAAGGWPILGHLHLFRGQGLLLHKIFGAMAEKHGPAFTIRLGMRPALVVSNWEVAKECFTANDRALASRPTSLALKIMGYNNSLFAFAPYGQYWRELRKIVMHQLLSSRRLELLKNVWLSEIDIWIKGLYENSLVNKVVDMKQWFGELMMNIVVRLVAGKRSFGKIREGDSEEAKAHQRQIKALRDFFRLVEVFMIEDAFPFLTWLDPRGYQKEMKNIAKELDYLLEEWLEEHKLKQQAACDDQSKDFMDVMLSEVKDSTITERDANTICKATCLNVILGASDTTTLTLTWALSLLLNNRHVLKKAQEELNAQVGKDKQVEESDMKNLVYLHAIIKEVLRLYPAAPLSVAHESLEDTVVAGYHVSKGTQVIFNLWKIQRDPSVWSNPLEFQPERFLTTHKHVDIWGQNFELIPFGSGRRMCPGVPFALQVVSLTLARLLHGFELTTPGGAAVDMTETPGLTNMKATPVEVFLRPDLPHQLYA

SEQ ID NO: 220 - protein, 524 aa, Thalictrum flavum
MPSQTIQIIMDFFHQCVATILFCVLASPFFFYYLLPWWKNANDHDLAKSRGKPVPEVDGAWPIIGHMHMLQPSDSFYSSLAEKYGPIFTLRIGLCKTIVINSWELAKECCTTHDRVFASSPEATAAKILGYDYAMFGRNPYGPYWREMRKIIITELVSNRRLELLKHIRVTEISTSIQELYQLWEARSSKNVKERVVVDMQKWFGDLMLNIGVEMVAGKRYFGASSNEDKEEARQLHKTFKDFSNLFGVPVLSDAIPFLRWLDYKGHIKAMKRCAKQVDCILHRWLEEHKQNKTTIAGDFMDILLSVLQDKEIFGRDADTVIKATCLNMMLGVVETNKVTVTMALISLLNNRRILKKAQEEIDIHVGSDKQVEESDIEKLVYLQAIVKETLRLYSPGLGTREPSEDCTISGFHVPKGTEVMVNVQQIHRDPSIWSNPLEFQPERFLTTQANIDFGGQHHEYIPFGAGRRLCPAISFAVLVVHLTLARLLQGFDFATPKDAPVEMNESVETLEVLITPRLPLHMY

SEQ ID NO: 221 - protein, 534 aa, Xanthoriza simplicissima
MHNPIPNQWLPSSTLLTPIIVSFLVIVLFYIYKKRSSNTIRTKKAPEVVGAWPVIGHLNLFSCPKPGHIVLGELADQYGPAFTIHFGMHPTLVVSSSELVRDCFTTNDKLFSSRLVNKAIKYMFYDQDTISFAPYGPYWRELRKMIALNLLNNERIKMLQQQRISEMDACLKKLYDLSAKRKDENAGVLVDMSKWFAEISFNVVTRIVAGKHIFGPKVERYKNVMEEARRLMDVMVFSDMVPYLGWLDRLRGVDSAIKRTAKELDSVLESWVEEHRRKSVSISAGTGGIFNIKEEEELDFIDIMLSIIAKNNLPGDDPDTLIKAIVQETYLAAWDNTTVTLTWVLCLLLNNKQVLKRAQNELDAQVGKERQVEDSDINNLPYVQAIVKESLRLYPPGPIIERATTEDCNVGGFRVPAGTRLWVNLWKLQRDPKVWPNDPLEFRPERFLNDNADIDLRGQNSELIPFGSGRRMCPGVSFSLQVIHLVIARIIQGFELKAPTDADIDMSTTLGMISWKATPLEVLMNPRFPPVFYK

SEQ ID NO: 222 - protein, 550 aa, Xanthoriza simplicissima
MSTLQISILTVKSPYSQMHYYPLLHQWLPASMALVSLLVIILFSIFKKRSSKMIKAKKAPEVAGAWPLIGHLNLFSGPKLLHLVLGELTDQYGPAFMIHLGMYPTLVVSNWELLKDCFTTNDIFFSNRPVNKAIKHMFYNKESIGFTPYGSYWRELRKMTTLKLLSNHRLDLLKPLRISEMDACFRNLYELWTKDKDGNAWLLVDMSKWFGEISFNVVARIVAGKKNFGSKGDRYKTVMEEVVRLMGLRALSDAVPYLGWLDQLRGLDSAMKRAAKELDSVLESWVEEHRLKRVSVSAGTGSTVKTAKEEEEEEDFIDITLSILAENQLPGDDPDTGIKSLILDMILGGSDTSTVTLIWAMCLLLNNVHVLKRAQYELDAQIGKERQVEDSDIKNLPYIQAIIKETMRLYPAGPIIERQANEDCDVGGFHVPAGTRLWVNLWKLQRDPNVWKDDALEFRPERFLTDHADIDLKGQHLELIPFGSGRRICPGISFALQVMHLALARIIHGFELKTPNDSNIDMSGTPGLLCCKATPLQVLLTPRFNPMFYK

SEQ ID NO: 223 - protein, 520 aa, Xanthoriza simplicissima
MDSLRHCLGGILALLIFLGYLQWKRGTSNKCIEAPQPDGAWPIIGHLPRLMKPQIMHRTLSTMADKHGPAFTLRLGVHKTLVVSSWEVAKECFTTNDRVFATRPTSIAVEILGYNYALFAFGPYGSYWREARKIAILELLSNHRLELLKHVRISEVSTSIRELYQVWKENCDIANGSALVDMKPWFGDLTLNVVVRMVAGKRYMGGSVKSDDVEGRRFQKATKDLFDLFGLFILSDALPFMGWLDLHGHKKAMKKTAKELDSIMQRWLEEHRQSLLDDGTKEEKKDFMYVMLSILEDKKLFQYDADIVNKAICMNMIMAGTDTQMITLTWVLSLLLNNRHILKKAQDEIDSSVGKDRQVEESDIVKLVYLQAIVKEALRLYPPAPLSAQHEAMEDCTVAGYYVPAGTRLITNIRKIQRDPRVWSDPFEFHPERFLTNQANVDFRGQSFEFIPFGSGRRMCPGISFALQVVHLTLARILQGFDFETPMNASVDMTEAPGLTNVKSTPLQVLITPRLHPNLY

SEQ ID NO: 224 - protein, 523 aa, Xanthoriza simplicissima
MDLLNPYFATIFGGFFALLIFLFIISQKRSRIPKIRAAPEPVGAWPIVGHLPMLLGPRLPHFVLGDLGEKYGSAFTLRLGIHKTLVVSSWEVAKECFTTNDQVFATRPSFMAAKIMGYNYALFGLAPYGSYWRELRKISIIELLSSHRLELLKHVRVSEVSTSMKELYEVWAENCSNGNGSVLVEMQRWFGDLTLNISVRMVAGKRYFGTSASLDDDEARRISKATKDFFRLTGMFVVSDSVPFLWWLDFQGHEKAMKRTAKEMDDIFGGWLEDHRRNKLAGGTKVQQDFMDVMLSILEDEKFFGYNADVVTKATCLNMLLGGTDTTMVTLTWALSLLLNNRHILKKAQTEINTHVGKDTQVDESDIVKLVYLQAIVKETLRLYPAAPLSTPHEATKDCTIAGYHVTAGTRLITNIWKIQRDPRVWSNPSEFQPERFLTDQANVDVRGQHFEFIPFGSGRRSCPGISLGLLVVQLALARLLQGFDFETPSDALVDMTESAGLTNLKATPLHVLITPRLHSSLY

SEQ ID NO: 225 - protein, 530 aa, Xanthoriza simplicissima
MDSVHQGQYLPTPMVSVFVFFISLYFLIVWKTRSSSKTNTCNEVPEAPGAWPIIGHLHLLGGSELPHKTLGAMADKYGPIFKIRIGVHQALVVSSSDIVKECFTTNDKVFASRPTSTASKILGYDYVMFGFSPYGPYWIELRKIIMSELLSNRRLELLKHVRDSEIDISIQELYKVWKNHDKSKGPILVDMKQWFGDLALNVILRMIAGKRYSGSIFSSDETEARRCQKGARDFFRLLGLFIIEDALPYLSWFDLQGYKKEMKNTAKELDSVFQRWLEEHKRTRETGELNREQDFMDILMSTLEETKISEYDNDTIIKSTCLSIVTGGNDTTMVTLTWILSLLLNNKHALKKVQDELDSHVGKHRHVEESDIKNLIYLQAIMKEALRLYPAGPLSGPRVADADCTLAGYHIPAGTRLLVNTYKIQRDPLVWSEPSEFRPERFLTSHVNMDVKGLQYELIPFGTGRRACPGMLFALQVVPLVLARFLHEFEPKTEMDMPVDMTETAGLSNAKATPLEVVITPRLQPELYSL

SEQ ID NO: 226 - protein, 528 aa, Xanthoriza simplicissima
MDFTMIIQWLLTSFAILVAFVLIWSSATRSSTRKRNKTAPVAAGALPIVGHLHMLMGRELPHRLLSNMADKYGPAFMMKYGLQPALVVSSLKLTKECFVHNDRAVFKRPRSKALKNLTYDQASLGFAPYGPLWVEMRKVSKTNLLSNQRLQMQRHVRASEVDAFIKELYDLWSSKSNNIKGAPLLVEMNKWFEELALNVVTRMLSGKRHIGFKARRGEDSESMHYKKVVVDATLLTAKLVVSDFFPSLGLVDYLQGDESSIKGTSKELDAILATWVEEHRHKKVSGSEDDEKDFIDLTLSMIDQTQHQGADVDTFIKSMCVGMIFGGSDSTSVALAWALSILMNNRPVLKKAREEIDRQVGRDRKVNDLDVLKLDYLKAIVKESMRLCLVGPLLERVAVEDCEIGGYHVKAGSRVVVNIWKMQHDPNLWSDPLEFQPERFLTTNANVELRGQHFELLPFGAGSRICPGITFALELIQLTLARLIHGFELGTPMDADVDMTETSSVTNYRATPLEILLTPRLDPKLYNY

SEQ ID NO: 227 - DNA, 1522 bp, Berberis thunbergii
accccctatacagtatatggatttgcaaatttcatctcatgttgcagtataatttggcatatgtgagatgaaacagagttttcgtaaatttgacatggacgactcacaaacatatcttcttaaagcataacagatagtcagttacaaataccctgtgcaacacactatgcactaggagtcgtggatacatattcaagaagcttttcatcttgttcgaactcagccatgtcttcatctaacatgttcacccatgcttctatgccatctccggtccttgtatccatcaatataataagatccctacaaggaaaaccacttatgcttacccatgtaggttttccccaaccaaagtcagtttcgtaccaaggaaacctacaccaactactgaatatagccaaacccgtctcacctttggcaactcctgctagtccacccaagaacgattccaagtaggcattaccacatagtattcttctcaaatacttgccatcaattttacttatagcatccctgagcttgcttacaagtatgtgaggctctttcttgccatccaaatcctgacttgccgtgaaggttgatccaaatacatttcctaaggtgttctcaagtccttcaaccttcaatggtggatccattctcctccgaaagttgactgcatgtattgctacatattccttcaagagtccatttttagctcgagttgattccataaaacgcctccatatcaaggctgacacggcttcaatgcgtgtgggatatgagacatgtgagctattagcccccgttgcccttagggatgctatctttgatgcatcaaatacaaaccttttggttacaatctttcctttacctctatgaatgaatgcggatggaatgtaaccaagtaaatctctctgagggaaaatagaggagagctcagagatgggaaggatttcttctttacaattgtgagtttttgcagcccaacaattgatgaatttgctcatggaataagcatcagaaatcttatgtgacaagcacacacatatcattatccctccacaatcaaatacattgacttggatggctaagagtactttggacccaaacttaggtccatgtgcagtatcagcatcatcaaaatggggttcatcacatggtgagaacatttttagtacatcagcaacatttggttgcacaatcacttctgataatagaccgctgacacgagcttctacatagttagcaccttcatcattgcagtcgacagaggtattaccatttatcctccctgctaacgggtagaagctagttaatgtttctgatagagatctcttttggcgacaatgtaaaccagcgttttcaatgtcattgggactgttgtcagcatagaaaaggaagataggaatataaaatggaggagcaatctgatcaaggaagcagaggttgaaggttttaaggtaaggaggagttggagaggatggcttgatggactctcttgagataacttgaaccttcatcttcatcttagagttaaggagac

SEQ ID NO: 228 - DNA, 1986 bp, Chordyalis celanthifolia
aaaatcaatatatctaaaaaaccaattgttaaaacgtccacattacttttgcaccatttgatggttaggagaaggtgcaatgcgctcaccaattcagagatttcaacgccagaagaagaagaagaagaagaagtgggtgtcatatgtttgttatacatccagctaagttgttgttgttgttgcatttgccaaaaactactcaccgatcacaagctagcaactgctttcgttaatggagtatagcagctattaagcaagcttgctctcagtctcatctggaaggaagctcacctatcacaactgcttcaaaggccggaaataaattagagatggcggattcaaaatcatcatctgtagtggaagtcatctccaaagagaccatcaaaccatcaattccaacaccagagcatctcaaaactatcaaaatctccctccttgatcaactctctcctccactctatgtacccatcattctcttctacacagctgctgctgctactgatgatgatgataaagaaatctacgaaaatctcgaatataaatccaatatactaaagaaatctctatcagaaacattgacgcacttctacccgttggccggaagaatgaaagataacatggtgatcgattgtaacgacgaaggtgttgactatttcgaagcacgagtcagtggaaacatgtcagaattcatgaaaccagatgcagtgcctcaatttcttccttatgatgtcagttgtaattactcgggtaatggtaagatacaacttggtgttcaagttaacaagtttgattgtggtggaatagccattggtgtatgcatctcacacaaaacagcggatgcatcatcaatgagtgcattcatcaatggttgggcttccaccgctcgtaccggtgccaccgaatctccaacatttgatttggttcatctgtacccaccttcttgtgtacaaatacccagtgagaactccttcacaacacaagtagaaggagagaaggttgtcacgaaaagattcgtatttgatgcatccaagatagccaacctccgagccaaattaggagatgatgatgatgataagaagacaattacacgcgtccaagccgtgacgggacttatttggaaatgtgccatgtctaaatgggcacatacttcctcttcaaccagttccaaactatccatagcgaatctcgctgtgaacatacgatggaggatggacccaccgttggatcaactgtcatacggaaatttactcacactagcaacagcagcatcaacgacggagggtggatcattggaggaattagtgggccaattgaaggttgctctgagtaaaattgatgctgaaactatcaagtacattcaaggtgaaggaggattcatgaggcttcaagagttactagggagggtacatgagatgtttgccaaaggtgatgaggttgaggtttatatgtttagcagttggtgtagatttcctgtttatgaagctgatttcggttgggggaggccgacctgggtgagctgcagcagtcaaccatacaagaatactgtgatattgatggatactagaagtggcgatggaattgaagcgtgggtgaatttggttgaggatgacatgactctgtttcaacaaaatcaagaacttcttgaatttgttagctacaccgatatttgaccataactgttattcgatattttgcatgcttcaaagtcagagttaactcggtgcgccagccgcccgatcaacctgcctcaattaattgtttgggaactagctagctagctagctaggaaactggttagtcagtattcgttgatctggctgctggcttttgggaattctgtctatagttgtgatgagtgaattgtttgtgttgaggtattcaaatttgatgtagttaatttagaaaaagttaggtttaatttgttttaatattttgcttattattctttaatgaagttgcttaattgtttggcattgtatatcttat

SEQ ID NO: 229 - DNA, 1005 bp, Chelidonium majus
gcctaaaattgaaaataagagaatacaaagtaacaagaacataccgtaagagtacaataccgagaaatccgacaagaaaaagagaaggattaccggagtaagacaaatacaagtatgaaaacaagagaataaagatggtagttaagatggacaaacacgacaattgacctctattagggaaacggttgaaaatcaaaacagttggaggatctctcttaggtggtgttcgaacttggtcatatcatcctccagaaaattcacccacacttcaattccttcaccacatttcatatcgttcatgaaaaccatgttcttgtactttggctcaattaatggaacagtagttacccaaactggcgttccccaaccaaaatcagcttcgtagaatccaaacttgcaccagctagtcataaacaaagctgtcaccttatcttcaacatcactgtctttcgctacggaagcatcatgaccatagatgaacttttgaatgattttctccatgcaacctttatcaccctttaccttatctatttcgcgcctcaatagggctacaaaatcacttaactcatcaagtgccacttgctcttcattactcgtactactaacttttttggttgctggatttgttgttgtcgccgttgttgctggtaatactgctgtaacaaccacacaaagattcccgaatgacgcatcttgtaatggtggatccattttctttctaaagttcatggcatgggttacagtggatatagaaccgggcggagcagatttcactgctgacttccatatcaaagcggaaactacctcaacccttgtcggcctatggcatttgtatttatcatgcatcaaggattgcaatttttcacgtgcagatgtaatctttgccgcatcaaacacaaatcttttgctgacaagtttatctacgctggtactatcctgtgtaggataggaaacttgagatgccaattgttcactaggtggaaagagtgatgtcgaatcgaaaga

SEQ ID NO: 230 - DNA, 1547 bp, Chelidonium majus
cacaacttagaacgctaaccaagttgatcaagatggaccccaaaattaaagtagtactcatctcaaatgagaccatcaaaccttcatctccaactccccatcacctcagaaatttcaacttctcccttatcgatcagttctcttctccaatttatattcccattattcttttctacgaccaagtcatcgatagcaacattgacgacgaccaccgatcaaatcgccttaagagatcgttatcagaaacactaacccgattctaccccgtcgcaggtaggatcaatggaaacgtatccattgactgtaacgacgaaggtgtcgactattttgaaacaagaattcaaggtaagatgtctgattttatggtgagaccggaattatataatcacctcttaccatctcatatagtttccaacatatttgctacggatgcacaattagccgttcaagtcaacgtgtttgactgtggtggactggcaatttgtttttgtatgtcacacaagattgccgatgcatcaagcatgaccactttcatcaacgactgggctgccaccactcgtggttccatggccgaaagtgtgggtcccattttcgaatccgcctcgctcttcccagctagagacatacttaaaacatcaatagaacccgtaccagacacggctggagtagacgtcgtgaccaagaggtttgtatttgacgcgtccatgatagctgctctgcgtgccaagattcagggtactactgttacaagtgtcgggaagtacccgacacgtgttgaggccgtgtccggtttaatatggaagtcaaccatagaaatgagtaaagtaaaattggaatcgggttcttcaacaaaaccgttaaaagcgatggttgtccaccactcggtgaacttgagaaagagaatggacccaccattggctgacgtgtcatttggaaatatcatcactttaacaagcgcagttgcatcatcaactatgatcatgtcccaagaagtagagctggaggaattggtgggtaaactaagggcagccataagtaggatcaacatcagcgattacataaacaaaatgctaggttgtgatgatgatgatgaggagttcgtaagattgcttaaagtgagtaatcgcttcgcaaaagaagtaaataatgatgatcacgttgatggggaggacaacaccgacactgatgccgattccaatgcagatgatgatgatgtttactggatgagcagttggtgtagatttccagtttatgaaagtgattttgggtgggggaaaccaacatttgtatgtacaaaacagtcatacaagaatgtggttattttgatggatacaagatgtggcggtggaatagaagcgtgggtgagtttggtggaggatgacatggccatattcgagcgtaaccccaatcttcttcaatttgtttccacaattaactaattagattggaaaaactagtttgtagatggggtgatttggttaaaaaagtgtaattgatttgtactagataactatctgtcatgtgtatagattattatgcaataaaag

SEQ ID NO: 231 - DNA, 1512 bp, Chelidonium majus
aggagttccaaggcatagtagagtaaagttcattaagcaaaatggtgctaaaggttgaaattatctcaaaagaaaccatcaaaccatcctctccaacacctattcaccttagaagcttcaaactttccttcttagatcagatcactcctcccattcctttcaatatccttttcttctaccctgcttccgatggttcattcgacaatgtcaaacgatctgatcggctaaagaaatctttatcggagacgttaacctatttctacccgttagcaggaacaatcggtgacaacataactgtccaatgtgatgacaatggtgttcagttcttggaaacccaagtcaattgtcaactctctaaagttcttaaacatcctgaagctcaagttatgaagcagttcttgccagaccctggtatgatgtgcaatgaattgggtaagggattgcaattagcaattcaagtcaatatgttcgactgcggcggaatggtgataggaatgactgtgttgcacaagattattgatgcaggatctttgagcacattcattaatgcttgggctcgaactgctcgtggaaccgacgagactttgggtccccgtttcgactccgcatctcttttccctcctaatgaagtacccgggactacattcctaccgatgaaaatgaaccccaattctgctgagaagattgttacaaagaaatttgtctttgatgcttcaaacatagctgctcttagagccaaagcttctcattctgaacatgtgaagaatccaacccgggtagaatcggtgtcagcactcttatggaagtgtgcttggaacgccaaatcgaaatctagtgtggcgaatgtgattgtgaattttcgtagtagaatcgttccaccattgcctgaaaattcttttgggaatctaattgggatgtcaacgacaaagataacgaatcatgaagaagcagagttgcattacttggcaagaaatctgagagatgcgatacggaaaatcaacaatgattacatgaaagaattacaaaatgatggatcattaaggtcgacattagaagcacctcatgaagagttcaacaatgatgaggtagaggtctatacaatgactagttggtgtagatttcctttctatgaagtcgactttggatgggggaagcccatttggatatctactgttaatttgcttgtcaagaacggttttatgttaatggatacaagatgtggaagtggaattgaagcatgggtgaccttggatgaacagaaaatggctgaatttgaatctgatctcgatcgagcttcacaaattcatttctcacaaaaccaatagaccgatgcgtaatcgacttttcgcacaatgcattagattgtaatcggggtttttttagccgttatatgtgtatcaatctctttgtgaaaattaagacagaataagttcaagcctcaagtacattgatacgacgatatctaacgtacttgtagaatatttgctttacacactattgcctaatagccgc

SEQ ID NO: 232 - DNA, 1615 bp, Cissampelos mucronata
aatgcatttatatatatttttcttaccacacccatcccaagttgatgtgttgcatgaaaatcctaatgtatactatatatgtagaatgctctagtgtgataaaatacagaacatataaagaattttactccttatgcagtgagaatagtaacccttaatggatgaccaccattagagaagactcagaagagtagaaccttagttgatgatgaagggcactacaggtgctcagtcaagactcaagtattggaaacaaaggagaggaactcctcatctttctccaactcaaccaagtcttcctccaccatgttcaaccaagcttcaatcccatcaccaaacttactatctatcagtatcacaaggttctttccaggagtcttagttgtggaaacccaaatgggccttccccacccaaaatttgcgtcataaaaagggaacctacaccaactgttgaagttcattgccacaacctctccttttgagaactgcttctgtatttcttcaattgaattcatgaacccttcttccccacattgaagtttcctcacataatcaccatccactctcctcattgcatctctcaagtgcttcaccaacacatgacgatcacttcttgtgtcacttccaaactccacacattttgtaattgttggccttgatgcattcccaaatgcattgcttggcagtggtggcaccattctccccctcaagttcactgcgtgcactgctatagatgccctttcaggtcctgcctttgctctagtcgcggcaatggcgcgctcccaaatgaacgccgacaccgcttctactcgagttggatgctccacttcggtgcctcttaaagcagcaaccttctcgcccttgaatacaaatctcctggtcacaatgttgctaccttctccaactccaccgcggccactcggggttgctccatctgaatctttagcagggaagagagaaggcaagtcgaacgacggattaggcagagcatttttactagaaccattagctgcatcagcccaaaatcttatgaacgtcgccattgctgctccgtcggcaatcttgtgcgaaaagcagacgcctaatgccatcccgccgcaatcaaaatagttggcttgaactcctaggagtgccttggcaggcaattcttcattagtcacataaggtgcacaaggaagaagtttatcaaggtcatcaatgttaggccgtttgagaaactcagcgagtcgaacacccgccttggcttccgaaaactcgactccctgaccatcgcaatcgactgcggcgccatccctgattctccctgccactgggtagaaatgagttaaggtttctgaaagagatgtcttcagctgatcagaccttttggagatgtgatcttcatggtttccaacaccacaacctgatgggtagaagaggatgatagtaacatagtttgaagtggctagatgatccaacaaggacagtttgagagagttttcgcgatgaggatcgactggagtcgatggtgagatgttctctctagagattatttggacctccatgtatgggtaaaaagaggctcttctagattgctaattttgtcctctgatgaagactaggccagcagagtctt

SEQ ID NO: 233 - DNA, 1732 bp, Cocculus trilobus
taggataacataaaaacagtagacctgatttagcaatctcatgattgaaaactgctctctagcccttcctcctctttccctatcacagtacccaaagtgcacccttttgagtcctaatgattcttcctttttatttgcaacaaataactaatctaggacaacatgattctcagataaagaaattccagagcaacttgtctaaatataccaacatgatcatcacaatttcatagatataacttctttgctttctaaatttccatgagttcttggaaaatcttcatggatgaagcagggagaccaagaagaacatttatgcttttcctctctttcccatgagacaagaacaaaatgacttccttctcaggcagagtcactggccctgataaaataggttctccccacccgaaatcggtaatatggaatgaaagcctagaccatgtggttattagaagagttgcagcaagtgaaggcctggctcttgttacttcaaagtaatctatagctgatctcatgtaactatcagtgaccatcttcaccgccctctgaaccaatcccactgtaaatgacaatggattctccaacacctcgcccgcattgcacaaagagttcgttaacacgattccgttcccagagtatccctttggcaatgggggctcgaacctaggcctcccatccacagcaaagaggagctttatctgttgatcaggtttcatcttcaaggcctcacatctagccttccacacaaatgcagagagagcctcaaaggttgtgcattttgcgatgacattatcttccatagcttttttcttgagttgttctarcttctgagtgtcaaagcagaaggacctgtagagcatttcctcttcgtagagactggaagtkttcgatatrtcctcgatctcygcgaattcttggtgggtaaactctattttaggagggattcgagccttgagtatgcttctgtctaggaacggcggaacagttagcggttcacctcgggcggtctctccccatgagttcacgaactccatggctcctagaccatcaaacatgcaatgattcatgcatagcccaagaacgaatcctccacacttgaattttgtaatctgagccacgagagggggcatttcaagtatgttctttgcaccaggaatgtcataaaccaactttcctagtgtcactggatcaggttttgtgatgtctcctatgtcttccatcttacaatctgcctcagcctcaacaaaaacacctccttcgcctgtgcaatggacgatcaacttcccttccgaactgatcgtaagacgcccggccatgggataataatgaacaagaacctttgccaaggcatcctttaggacctcccctgctctctcattacccttctcttccgacttgaagcaataaacagttcgaatgatcaccgcgatgttttggtcsaggttagagaggaagtagagacccttcggcgtgtcctcagcaggaggaacaagagttggttctcctaccttcacactaagctcaaacacattcccattagaagatttctgatccattgcaacagactctccaagctcaacaacctgaaaccaaaaagaagaagataaatttttttttattagagtactcataaggagagacccatatcatatgatggaacaaagtgatcatagttgatgcatttaaatgtgatattccttagtttgttagaaaacagaccatgtgtaagaac

SEQ ID NO: 234 - DNA, 1641 bp, Eschscholzia californica
ccattttaggcccaactatccaaatttcgatcacagcatcacattggcgttttaacaatagtacctaatctcatgtttacttgttcttgtaaacagaaaactgtcaattacgacaacccatatcaataaaacgttgcaatatgactaagtgagacgaaaaatcgttaaagctagtggatataaaacatttgatgaataacataaagtatgataacattctctaaaaaaatgaaattacatatattaatttgtttataacttacgcgtgttcacttagttacataggcaaattcgaggaggttctcattacactcgaaagcggtcatatctttttcttccaattttacccatgcttcaattccttcaccatctctagtgtccatcaaaacaatcccattcttggctagtgcttgacctacactataagttacccaaactggttttccccatccaaaatcactctcatagaatggaaatctacaccaactactcatcatatacatatttttaccatcttcattcatcaaacctgcctccttagttacccattttatgaactcttcaccactatcacctcgaagttttctcacataatcttcgtcgatcttatgtattgatacccggagatgtcctaccaattcatctaacgaataagaattcttcggtattaaggttgttgttgccaaggtcactatattcccgaatgactcttgagtcaatggtgggtccattttccttcttaaattcacagcttggtttaggattgacatagactctgcctcagggttcatgagtgatttccaaattagagctgacacagcctctacccgtgtcggatacttcccattagaagttttggctatcctggcgcgtaaacttgctatattggctgcatcaaatacaaatctttttgctacgagtttgttttcaattgttccatctttgagttcgacaggcgtgtcaggtacaggaaacgatacttgtctaactgaaaagagagaatgggcgtcaaaattaggaatgacaaattcggtttccccacgagccgttgctgcccaacagttgatgaaggttgcaatagatgatgcatcaaagagcttatgcgacatacacatcgatattgctattcctccacagtcaaacatgttgacttgaatgatcaatggtgttcgactggccatatctaaagtgggtatgagctgattaagtagatctgcgcttctaaattctgtgatgttaccattgacttttgcttcgaagtagtcaacacctagatcgttgcactcaacgaagatgttatctttgatcctaccggccaatgggtagtaacgggttaagacgttagacaaagattttttaagtaaatgatgatagttagattcggattcaaatgaatttgtgtgattagattcgaagaaaagaacgacaggaacgtaaactggataaataacctgatcaagaagagagagtttgtatggagaaaggtgagaaggagttgaagaagagggtttgattatctccttagaaatgactcttaccaatttatccatcattactgccatgaatgaatcttttgaacaatctgtgaggactttatattatttttttctctctctctatatttcttcatcttatagatgt

SEQ ID NO: 235 - DNA, 1723 bp, Glaucium flavum
cctccctttggtcggccgataaaaggcctccctttggtgggccaataagtgtcctacgataaattcaatagtacccaatgtattgatatttttcaaacaattacttagcagatcgtggaagcaaattccaggagttgggcgtcacgctcgaatacggccatatcatcctccactaaacttacccacgcttctattccgtcaccacaactcgtatcaatcataataactacatttttataggactgatatgaacttaccataactggtttcccccacccaaaatcactttcatacagtggaaatctacaccaactacccatccagtaaacctcatgatcgtcatcgctgtcgtcgttgtggtcagtgacctcgtctccattatttacttttttcgcgaaacgaccactctcgttgaccaatctcaagaactcctcatcatcatcaccaccactttgcaatttcttgatgtaatccccgttgatcttacttatggctgccctaagttgtctcactaattcctccacgtctacttgtttagccatcaacatcgttggtgatgctactgcggttgccaaagtgatcatatttccaaatgaccggtcagccaacaatgggtccatcctctttctcaagctcaccgtgtggtgcaccaccatacactttaccggtttccttaaggaactcgattcgatttttaattttttcactttactcatttccatgaatgatttccatatcaaagcggatacggcctcaacgcgtgacgggaagtatccgactcgtggagtggaggtgttctggattttggcgcgtagagcggctatcatggatgcgtcaaacacgaacctctttgtcacgaccgctttattaacgtctccgattgtacgattgtctatcccatgcgtgtccggtccgggtactgctaatgtgttaagtatttctctcggtgggaagagaaaggccgacttgaaagtgggcgacagagtttttgtggatccacgattggtggcggcccagtcgttgatgaaagtggtcatagaggatgcatcggctatcttgtgtgacatgcaaaaactaattgctgttccaccacaggcaaacacgttgacttgaacggctaattgtgcatctttagccaatatgttggaagctatatgacatggtaagaggtgatggtgttcccgcggtcttgtcataaaggcagacatcttaccgtggattcttgtttcataatagtcgatgccttcatcgttgcagtcaacggatgagctatctttgatccttccagcgacagggtaaaattgggttagggtttctgaaagcgatctcttaagccgattagatcggtggtcaatatcatcgacttggttcccttcagtaggacagtcaccaaggggtgcagcagcagcatagaaaagaatgatgggaacgtaatgtggactagagaactgatctaggggtgtaaatgggcagggccgtaacggatagggcagggcagcgtatgtcatgaaatatgatatccattaaggcccttagggcagggcaaggtagtcctctttacattttctcttgcccactactctcccaatcctggtaccctagtagagcaggacgggcaaagtcgggcagggtacagggtacttgaaatgtaacaatacagttttaagcataaaaaaattgattttacacttgaatttagaaatcagatatttgttttatacaa

SEQ ID NO: 236 - DNA, 1741 bp, Glaucium flavum
gagacaaaatctaattactagattcgaactgatacgtttagtagatcaatactcttggcatgcaaaacataccaagatggagcctaaatatacacatttattgcttcattacaaacgaaatatgtatactgaactgtaatacaaaatataaatatcaacaatagacattatcacacaaccaaatacacaaaattataggaacataacatgattgaatttgaaacgaagaaactttgaagcacccggcaggagatcgaaatatagtaacattttccttttttcacctcagactgatcgagctgaataagaagttattaagtcgccaggactaggaatctaagaagcaaatttaagaaattccttgtcacattcaaattcatccatgtcttctttagtcatgttcacccatgcttctattccgtctcctgatctcgtgtccatgaacacaacaacatttttgaaaggaagcggagcagtcgctgcccaggttggctttccccatccgaaatctgcttcatatatgccgaacctgcaccagctactaaagtgtagcatcacattcgacgtctgattatttgaagcagcgttttccatttgtttcttgtaaaaattgaagtatgcatctgtatgttgtagtttcctaacatgatcaccatcgattctctttatggcctctccaattttcacaatcaaggttggatacggatgatctcccttgccctcagcatcaacgaggagcgcaaaagtaggactatacatattgccaaaagcgtttgttggcaattgtggaaccatccttttcctcaaattcactgcttgtgttaccctatacacccgtgccgaagcttcttcttttgcttgattcagtttcatgaaacgcttccaaacgaaggccgataaagcttcaacacgggttgggcactctcgatgtccgtcgccgtttatgttagtagcattggtttctactacactttgtttcttgagttcagttatcttggatgcttcaaaaacaaacctctttgtcacaatttgttgtttgtttttcttgatacttcctagggtattataacccatcagatctaccttgggaaacaaagttggcaactcaaaacaaggatccataatttgatcagtagcaccacgagcacaagcggcccagtcgttgataaacgtagacagtgaagaagcatcagctagcgtgtgtgagatgcatataccgatcactattccaccacaatcctcaaagacgttcacttgcacggccaagagcacttttgacgtgacgggtgtggactgattggtgctgtacgaatcacatggcaagaattgttgaagtacatggacctcagggtgttggataatttgagagagttcaccattagttactttggtttccaaataatcaacaccctcatcgttacaatcgacagagccctcatcttggatccttccagccaatggatagaatctggttaagctcgcagataaagatttcttaattatgtcaggaaaatgagagttattgtcgttgtcgtattcatcacttttgtagaaaagaacaagtggaacataaattggaggagcaagctgatcaagaaaagataggttgaaggttctaaggtgatgaggagttggagaggatggttttatcatctccctcgacactacttcaaccttcattttcatggtgttaaaatcttggcttagttagctaagagttgaagaaaactttattttcttt

SEQ ID NO: 237 - DNA, 1738 bp, Hydrastis canadensis
gcaacattggaataaatctcttgattcactcactttaattggatcaaacacaacaatttcatttattaagagtaacatttcaaaagattctgggcaaaatgactctaaatgttgaagttatctcaagagaaacaatcaaaccatcctctccaacaccccatcaccttaaaaacttcaaactctcacatttagatcaatacactcctccaattggtgtccctataattctcttttattcggcaaaccatttcgaaaaaacaaaaatgtctgatcggttaaagaaaacgttatcgaagaccttaactgatttctacccattaggaggaaagatcaaagataacaactcaattgactgcgacgacagtggtgttgaatacttggaaactcaagttaaagctcaactctaccaatttctcaactgtcctgaagctgatgaattgaatcaattaattccattgaatctaaactgcactggaatgagctcagaaatacaattagcaattcaagtgaacgtattcgaatgtggtggaattgcgatcgcagcatgtatatcacacaaagttgctgatgcatcaagcttgtgcacatttttaagtaattgggctgccaatgctcgcggggctaatcatgttgtgtttccacagtttgattcagctccactcttccctcctagagaagtatcttcacttcaactaagcaccgaaggcccaacgcacaacgttgtcaccaaaaggtttatcttcgattcatccaatatagctgctctcaaagccaagtctgccaattatgtggagaatccgacaagggtggaagctgtggcgaccttcctatggaggtgtttcatgaatgtagctagtttgaaaccaggatctataaaatcatttatggtgaacattgcggtgaatttgcgtagtagaatggttccaccattgccagatcattcttttggtaatctcattatggctgcaatgccttcctccacggcggatagtaaagcagaattgcattgtttggtggggcagttaagggaagcgataaggagatacgacggtgattatatgaaaaatttacaagatggtgatggtgtatcaatgttttatgattctatgagacaggcaattgaactatttgccaaaggagaaatggggttctacacaattactagttggtgtaggttccctttctatgaaattgattttgggtgggggaagcccatatgggcaagttctcttaacatggttcataaaaatgtggttatcttaatggatacaaaatatggtgatggaatagaagcattggtgactttggatgaagaagacatggcaagatttgaatgtgaggaagagctccttgcttttactagccccaagaatatagcttatgtgcaagagctccatgattttactaaccccattaagatggcttatgaacaagaggtccttgcttctactagcccaaatgggatggcttatgagaagagatccttgatttcactaggctaaatgggatggcttatgagttcaagtcaaccatgattcctagatcatataatcaccgtctttaattatgttctcctttcttttatgcttcttagttgttaaaatgttgctgttttttgtgtgtgtgtttgtgtttgtgtgcgcgctattatgctatgttcaaagccagagtagctcgtacctgatctttgatctattttgtgatcaagctattaaaatgccattcctagttattttgg

SEQ ID NO: 238 - DNA, 1721 bp, Jeffersonia diphylla
ccaatcaaacaacagaggactaggattccaccaggaattcatcaggaaaaatcccaaatgaaaaaatagcaaggattccatttcttcggagcaattttccctgtgtcctgcaatcaaactagccctaattgaagttggtgattacatcaaaaagctttcagactagtactaaagtggcgaaagcaaacatcctgtgtgtggcttaactcaactaacagtccacacaatgagttgaggagagaaatgagaggagttgttcatcttgttcaaattcagccatatcttcttccgccatcctcaccaacgcctcaatgccatctccagatcttgtatccatcaaggcaacaacatttttgaaatcattccttgcagaaataccagtagcccatacaggctttccccaaccaaagttagccttgtacaaaggaaacctacaccaactagtgaacattatcagccctgttttacctgtgctaattcctttgctatattcatcctctaaatgttgaatgtattcaccatcacgtcgtatttttgtcacaaactcgctgtccatttttcttatagcatctctaagctcgcccaccagcacatacaactcattttcgcttgctaactctcgacttgttgtgaaggttggagcacaaagatttcccaaggcgttctccaatcctttaccatccattctctttctcaagtctactatatgcattgccgcacattcctttaaaaacccattttttttcctagtcaattccatgaaacacctccataataaggcagacacaagttcaacgcgcgttggggatggaacacatgagctattattatttatcacctcggctctaagggatgcaatgttggatgaatcaaatacaaacttttggtgacaaggttcggtatagttgattgaaagggagcgctgttaaggtccaaaccactaggaggataaagagacgataattgttgagagatggggtggattagttgattagaatcggaagtcttagcagcccaagaatttataaatgtgatcattgagtaagcatctgaaattttatgtgacaagcaaacactaataactattcccccacactcaaataaattgacctggattgctaggagtacttttaaagataactggggttcttgatcatcacctggcgaaagcagttcaaggacttgatccacattgcgatgtttaatgacatcttcgagttgagctttcactcgagcttctacatagtcaacaccttcatcgttgcattcaattgcaatatatccgttcattctcccagctataggatagaagctacttaaggtttccgacagagatgtcttcaagcggcgggatatgtccgaaaactctatcttcttcgtatccttattatcatagaatagaaggatagaaaccctgtcaaaaccggctagcagatcaaaaagacctaatttgaaggttctaaggtgaggaggagttggagtagatggtttgatggactctctggacattatttcaacttgtattgacatctttaggtgagtgtgaattggtattcactgatgttgctctctatataattgagctcactatatgttgtgctgatcaaatttcatttggattcaacttgtattgcaatgccttgcattattgacaaataatggacaccctggaaagygayarsaracaagtaatggatattttgtttgttgtcacttgcgag

SEQ ID NO: 239 - DNA, 1565 bp, Mahonia aquifolium
ctcattcttccaagtcttttcgcttgctagaatccgcggtgatcattcgagaagagaagctttttgtatctgtatatacagggtaaagatgatcgtaaacatcaaggaaaccacgatggtgcgcccatcagagccgacgccaaaacggagcctatggaattctaatgtggacttggtggtgcctagaatgcacaccccaagtgtttacttttataggccaaatggttcatcaaatttctttgatgccaatgtgctcaaggaggctttgagtaaggctttggtaccattctaccctatgggtgctagacttaaaagggatgaagatggcaggattgaaattgattgtgatggacaaggagtgttgtttgtggaggctgagaccgtgtcggttatcgatgattttggggactttgcacctaccttggagctccggcaactcattcccactgtcgactattctggggatatttcttcgtatcctcttcttgtgctgcagataactcatttcaagtgtggaggggtctcacttggagtagggatgcaacaccacgtggcagatggagcatctgggctccacttcatcaacacatggtccgacatggcacgtggacttgacttgaccatcccacccttcattgaccggaccctcttacgagcacgtgacccgccgcgacccgctttcgaacaggtggagtacttacccccacccgcgatgaagaccccgctaagtacacccacagattccacctcagttgccatcttcaaaatcactagggagcaactcaacatattgaaagccaaatctaaggagggtggcaataccatcaactacagttcctacgaaatgctcgcgggtcatgtgtggcgatccgcgtgcaaggcacgagggttaccgtatgatcaagagacgaaaatgtacattgctaccgatggacgatctagattgcgcccagcacttccaccgggctacttcggcaatgttatattcaccaccacccccattgcggtatccggggacttgagtgctaagcctctaacctatgccgcgagtgtcattcatgaggcattagggcgaatggacgatgagtacatgcgctcggctctwgattatcttgaactacagcctgatctagcggccctcgttcgtggggcacactcatttagatgtcccaacatcgggatcacgagttggtcgaggcttccgattcatgatgcggactttgggtggggccggccgatcttcatgggccccggtgggattgcttatgaagggctcgcatttttgctgccgagcccgatcaatgatgggagcttgtcattggcgatttccttgcaatcggagcacatgaaagtattcgaaaaaattctttacgaattttaatcaacaaagagtggtgattcaatgaggttaatctcacagcgctcacttaataagagtgagactctcatccattggatcgaatggatagatctaattcttttattccatttaattaaaaagaatggggggaagttagaagtggaaatatcacaacctgaacattgtgtttctttagccaattgtc

SEQ ID NO: 240 - DNA, 1639 bp, Menispermum canadense
acacaaatgaagaagatgatgaagtacatgaaggtccaagtcgtttctaaagagaccatcaagccctcctctccaaccccacctcacctcagaacctacaacttctccctcatagatcaacacattcctcaacttctttatatacctttcatcctcttctactctcccaatatacatcacaaggaccacgatgatgatcatcatcgtcaactcatcaatattcaaacacaaagtcttgatcggctcaagacttccttgtcagaaacattaaccctgtattacccattagcagggaggataaaaaacgacagcataatctgctgcgaagatgaaggcgttgaattcgttcacaccaaagtaattgattctcccctcttagaacttgtcaacaaagctgaaccagaaaatctggctcaactcctcccgcgtcacgatcatcaacgcaacgaaaagccaccactactgagtattcagttcaatgcgttcgagtgcggtgggatggccatcggcctttggttttcacacaaagttgcagactcgtctagtctctgcactttcctccacaactgggcctctattgctcgtgggtcattgtctagtactgaaatcttgtgtcccaggttcgactgcgcgactcacttccctccaaaacaactgatgtcgccactgcaacatgtcaaaacaaaaggagaagtggtttcaaggaggtacatctttgatgcctccatgatagctgctcttaaagctaaagccagtactactatcaaccgcaactcatcatcgtcaatatcgccttcaagggtcttggcggtgatagcgttcttgtggaggactgtgatcgccatggatagagagaaacaattagggtctattaggcctttaaacatgggcattgcagtgagcttacgttctaagatggagctgacattgccagagctttcgtttggaaacctcgttgccatcgggatgacatccgcatttcatgagcaggaagtggtagaacgaattggggatttgttcggcaaattcaatagagattacgtgaaaaagctacagtccggtgaggagtacttgaagttgatggagtctttgggagaattggaagagcagatctgtagaggtgaagcggagaggtatggagtgactagttggtgcaggttcccattctatgaagttgattttggttggggaaagccagtgtgggctaacgttgctgcttttgaggacaataacttttttgtgttgatggatacgaggtttggtgagggaattgaagtttgggtgagcttgggtgaagatgacatggctagattccaacgacagttggatcgtgagcttctagtacttttcaactcgttcagctcggttggatcagcttgatgaaatattaacgctaaaataacgtacctttcttgcacaagtgttggaattcattagatatgcatggagatgtagtatgtatctccatgtacatatgcgcatttcaatatgtagacaattgtgtaagaaatatgcacgtgttaagaaatatctatataattgtgttattgtagcattatcgtcgctacatcttactcaagtgctcaagtgcttaacaagatgtagattaagttgacgaccctttgtataattactcatt

SEQ ID NO: 241 - DNA, 1495 bp, Nandina domestica
ccgatctgcagtgatgaaggttgagaaaatttcgagagatttcatcaaaccatcaactccaacccccgatcaccttcgaaccttcaggctgtctcttcttgatcagctcgctcatccagtttttgtccccatcattctcttctactctagtcccacaactactcttgatgatgatcatcagctaggtgtatctaatcagctcaagaagtctctatcggagaccttgaccctcttctacccgttagcaggaaggatcaaagataagctcttggtggattgtagcgatgaaggtattgagtatttcgaatctcgagtcaacggtaaaatttctgattttatgaaacgagatgaactgcatcatctcctaccttatgatttccaatctaccttgaatgtaattgttggtaacgattcacatttgatcgttcaagtcaacttgtttgactgtggtggaatagcaatttctgtttccatttcacataagctagccgacgcagcaacattgaccacatttatcaatacttgggcttccatcactcgtcaggcaatccccgaatcaattgtcagtccgacttttgattcagctattctgtatccacccagagaaggaatgtcctcacccttttctggtgcaattaataagcatttgaccagtaaggtacaagctggacaagccgaaaagagagtgacaaggaggtttgtgtttgatggcaccaaaatagcaacccttcgagcaagatatggtaattccaatgatgagaagaagaagaagaagaatttgcccacacgagtggaggctgtgactgcacttatttggaaaactgccatggcagcaacttcttccccaaaaccatcgattgcaaacattattgtggacatgaggagaaggctggacccaccattgccagagcaatcatttgggaatctcgcgacaacagttgcaagagtggcaccatccataacaaagagtactggagagatggatctgctgggtccaatgagggaatcgatacgtaaaatcaacagcgattccttgaaggtgcttcaaggtgatggagggttcataaagtttcaagagtttatgaagatggcattggaaacaaatgggaatgaattggagctatataggtttactagctggtgtagatttccggtgtatgaagcagatttcggttgggggaagccgaattgggtagctgttgctagtctgccattcaagaacacctctcttttgatggatgacagaacaggagatggaattgaagcctggatttgcttgttggaggaagacatggctagattcgaacgcgatcaggaactccttgatttcgttactttgttggactgagcagctcatgaactcctctttgttttcccgcaataaaatcaaatgtcatgtcactcaattcttacgtatgtatgcttgtatgaactgatattgactcgtactaattactttcctgttgttcattggatatggatctagctggtttct

SEQ ID NO: 242 - DNA, 1432 bp, Nigella sativa
tctagctaccaaggaatggaattgtaagtgtgtatattgatgcaaaatgactccgaaagtttcagttctgtcaagggaaactatcaagccatccctaccaacgcctcctcatctcagaaccttcagactctcccttttagatcagtacagttttccagttcgcgtccccgttattcttttctattttaacgatggagagaatgatcacactaaaatatccaagttgaagacatcgctttcggatatcttaacccatttctacccgttagctggaaggattgtgggtgatcgtttgattaactgtgatgacagtggtgttcagtacttggaagctcaggctaatacccagcttgaaacgtttctcaaatatcccaaagcggatgaattaaatcaactgctaccactgaaactacaccacaatgatgagagctcagaaacacaactgcaaatacaagtgaatacatttgaatgtggtggaattgcaattgctgcatctatatcccacatggttgcagatacagcaactttgtgttcattcataaatacatgggctgccaaaagttgcgggtgcagcaaaactatgcccccctgttttgattctgtagcactcttccctcctaaagaaataccttcattccagcttcccatgggagatcaaactcaaagggtaatctccaagaggtttgtcttccattcagcaaaacttgcagctttaagagccaaatcagtgagtaagctggaggtggagaaccccacacgggtggaggtcgtgtcagcacttgtgtggaaatgtctcatgaatgctgccactcggcgacaggggatgtcgtttacagtgaacatggcagtgaatttgcggagtagaatggttccaccattgtctgacaattcgtttgggaatctcattataggtgctttgccttctgctgaaagaggcgaagcattacattgtttggttgggaaattcaggaaaatgattaaaagagattactcgaaattaccggagaataatggaatatcaatatttcatgatgggttaaggaagacaatggaggcggcagcgagagggaaaattggaatgtacacaataactagttggtgtagatttccgttctatgaagctgatttcggatgggggaagccgatatgggcaactactgtgaatgtggatcataagaacattgtgatgctaatggacaccaaagatggtgacggaatagaagcattggtaacactagatgaacgggatatggctttgttcgaatgtcagcaggagctactcgactttgccatcccaaattcaatggtttcttgatatctacatctcctgccagcatctaacaactcagttgccaaagctgagaggttatgggttcaaactcgcaactgcttatgattgataaatgagttgtatacgtaagttgaagagagg

SEQ ID NO: 243 - DNA, 1705 bp, Papaver bracteatum
cagaaggcatcatgttgggaaggtgggaacaaataagctggagtatcttgagcacttgttcatgtctcaccttagtgtgaatcaattgattaagaccttgaatattgatattgtacagttgggattatatggaagctttgtctagtgttgatgtcgaagtgatctccaaggaaacaattaaacccacaactccaaccccatatcaacttagaaacttcaatctgtcccttcttgatcaatattgtcctatagtttatgttccaatcattcttttctaccctgctgcagtcactaatagttctggtagtaagcaccacgatgatcttaacttgcttaagagttctctttctgaaacgctgggtcaattttatccactggccggtaggatgaaagacaacattgtagtcgactgtaacgatgaaggtatcgactttatcgaagtaaaaatcaagagtaaattgtgcgacttcatgatgaatccagatgtacgcttaagtctgcttctcccatctggagtcgtttccatgaacttcgttaaggaagcacaggtgattgttcaagtgaacatatttgattgcggtggagcagccatttgtttgtgtatatcacacaagattgcagatgcatgcaccatgagtacattcactcgttattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgaaaagctacaagtattgatgcatgataaatacagatcccgtaagccaacaagggttgaggtggtttccgctctaatatggaaggcagccatgaaatccgctccgtctggtgcttcatcgacggtaaaccatgccgtgaactttagaaagaaaatggacccacctttacaagatgtgtcattcggaaatctttgtcaggtcgttgcagcattattaccagcaacaacgccggaaacaacagaaaattcagataacaagacagttaatagtacaagtaatgaagtgcaagtggcacttgatgagttaaatgatttcgtagctcaattgagaggcgaaatagataaggtaaagggcgacaaaagttgcatggagagaatgtttctaaatttcatgaatggttatgatgcctccgaaacgaaagacagtgatgttgaagatgaagtgatagctttttggatgactagctggtgcaactttggtttatatgatgctgatttcggttggggaaagccaatttgggtaactactgatccatttatcgagccgaacaagaacataatttacatgattgatacaaaatgtggtgaaggaatagaagtgtgggtaaactttcttgaggatgatatggctaagttcgagcatcacctaagcgagatcctcgaattgttttgattttgcatcatctactttgtgttccaaaatcatgtttggttttcgttattttctttaataaagagacttattgcaattatgatgactatatgcacatcctcatttttacactttgaatccttgctaaagagaagtgttcctttctaaacgaa

SEQ ID NO: 244 - DNA, 1751 bp, Papaver bracteatum
aaaagaatctaccttgaatattgatattgtacagttgggattatatggaagctttgtctagtgttgatgtcgaagtgatctccaaggaaacaattaaacccacaactccaaccccatatcaacttagaaacttcaatctgtcccttcttgatcaatattgtcctatagtttatgttccaatcattcttttctaccctgctgcagtcactaatagttctggtagtaagcaccacgatgatcttaacttgcttaagagttctctttctgaaacgctgggtcaattttatccactggccggtaggatgaaagacaacattgtagtcgactgtaacgatgaaggtatcgactttatcgaagtaaaaatcaagagtaaattgtgcgacttcatgatgaatccagatgtacgcttaagtctgcttctcccatctggagtcgtttccatgaacttcgttaaggaagcacaggtgatcgttcaagtgaacatatttgactgcggtggaacagccattagtgtgagtatatcacacaagattgcagatgcagccacaatgagtacattcactcgttattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgaaaagctacaagtattgatgcatgataaatacagatcccgtaagccaacaagggttgaggtggtttccgctctaatatggaaggcagccatgaaatccgctccgtctggtgcttcatcgacggtaaaccatgccgtgaactttagaaagaaaatggacccacctttacaagatgtgtcattcggaaatctttgtcaggtcgttgcagcattattaccagcaacaacgccgggtgcttcaccaacggtaaatcatgccgtgaacctaagaaagaaaatggacccaccattacaagatgagtcattcggaaatctttgtaaggccgttacagcaatattaccagcaacaacaaccacgacaacaacaaaaaatgaagacaacaaaacaatcaatagtacaagtaatgaagtgcaagtggcggtacttcatgaattaaatgattttatagctcaactgagaagcgaaatagataaggtaaagggcgacaaagattgcatggagaaaatcattcaaaatttcatgaatggttatgagtacgccaccacaaagaaaaaaaatgatgttgaagatgaagtgataaccttgtggatgactagctggtgcaacatgggattatacgagactgatttcggttggggaaagccaatttgggtaacgaccgatccaaatatcaagccgaacaaaaacataatttacatgaatgatacaaaatgtggtgaaggaatagaagtgtgggcaaactttcttgaggatgatatggctaagttcgagcatcacctaagcgagatcctcgaattgttttgattttgcatcatctactttgtgttccaaaatcatgtttggttttcgttattttctttagtaaagagacttattgcaattatgctgactatatgcacatcctcatttttacactttgatcactggggagtaaatttttgatggggccgtttt

SEQ ID NO: 245 - DNA, 1710 bp, Papaver bracteatum
cagaaggcatcatgttgggaaggtgggaacaaataagctggagtatcttgagcacttgttcatgtctcaccttagtgtgaatcaattgattaagaccttgaatattgatattgtacagttgggattatatggaagctttgtctagtgttgatgtcgaagtgatctccaaggaaacaattaaacccacaactccaaccccatatcaacttagaaacttcaatctgtcccttcttgatcaatattgtcctatagtttatgttccaatcattcttttctaccctgctgcagtcactaatagttctggtagtaagcaccacgatgatcttaacttgcttaagagttctctttctgaaacgctgggtcaattttatccactggccggtaggatgaaagacaacattgtagtcgactgtaacgatgaaggtatcgactttatcgaagtaaaaatcaagagtaaattgtgcgacttcatgatgaatccagatgtacgcttaagtctgcttctcccatctggagtcgtttccatgaacttcgttaaggaagcacaggtgattgttcaagtgaacatatttgattgcggtggagcagccatttgtttgtgtatatcacacaagattgcagatgcatgcaccatgagtacattcactcgttattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgatttgcttccttctttcgacgcggcaactcttttcccgccgagtgaacaactggtatgtccatcagaagtgccacccacacccgtttcccatcataatgacgatagcggaggagaaaaaagtgtcagcaaaagatttgtgttggatgcggtaaagataaactctgtgcgtgaaaagttacaaggattgatgcatgataactacaaatgcaccagcaggccaacaagggttgatgtggttacggctttggtatggaaggcagccatgaaatccgctcctagggatggttttttaccaatggtaaatcatgtgatgagcttcagaaagaaaatggatccaccattacctgatgcctcatttgggaatctctgtgcggtagtttcgacggcggtatcaccgggagcaacggcgacaagtacgaatgatgaggtactggaggaacagttagctgaattagtagctcagttgaggggagaaaaatacaaggtaaagggtgataaaggttgcattgagaaaatctttctaagttttgttggtggtgacaatgccttgtggatggctagctggtccaagtttgggttttatgatgctgattttggctggggaaagccggtttgggtaactactgatctatcagttgtcgagccgaaccagaacctaatttgcatgattgatacaaaatgtggtgaagggatagaagtttcagcaaaatttctggagaatgatatggccaagttcgaatttcacctaagcgagatcctcaaattgttttgatttttgcatcatctatttgtatttccaaaatggactataaaagggactgttagtc

SEQ ID NO: 246 - DNA, 1727 bp, Papaver bracteatum
gttcttcacttgttaatgctataagttaaatgaatacaagtgagttcatcttaccaaagacatcggaattcgttcttgatcaacatcatccatctttctgaaccagtttgtgatcttaaagcagccaaccatgtctaatattattgttgaggtgatctccaaagaaaccattaaaccttcaactccaactccgcatcagtttaaaaaccatagtctctcactcatcgatcaatacattgtccccagtttcgttccactcattttcttcttcccagcagtaccaggtctttacgaccacactgctggcaataagcaacatggtgataatattttgcttcttaagaggtctctttcagaaacattatctcacttttatccgctggcaggtagggtgaaggataatatcgttgttgactgtaacgaccaagggatcgaatttatcgaagccaaagtcagtggtagtatgtctgaatttttgaagaaacctgatgaccatctaagtgggcttcttccctctaaagttgtttgcatgaactatgttacaaatacacaagtgtttgttcaagtgaactcgttcgagtgccattcaacagccatatgtttgtgtgtatcgcacaaggttgccgatgtagctaccatcactacattcattcgctgttgggcacagactaatatctcagttagcagaaccacgtccataggctcaaagttgcatcctacttttgattcggcttctctcttcccacctattaaacaactagtatcgccaacgatggtaacacctacagaactggattcaactcccttggaagaaagtaaatcaatcagtaagatcatcagcaagaggtttgtgttcgacgctaaaatgataaattctgtacgtgaaaaaatatcagcaacaatggtggataaatacaaaagtcgtaggttgtcaagggttgagatagtctccgcattgatatggaagtcattcgttaaattggcaacccctggttcttcatcagtaattgtaagacatgccgtgaaccttagaaggagaatcgacccaccattaccagatgtgtcatttggaaatattttagagttcaccaaactagtagtaggatcagcatcaacaacaacccaagggaccagtaagctgcatgaagacttaaatgaatttgtatgtcaactgagggaatcaataagtaaaatgaacaagggtgatcatgatttcgacatggaaaacactgaaaatgaagggagaaatttgtggatgagtagttggggtagttacggatcgtatgatattgattttggttggggaaaaccaatttgggtaactactgttggacctatgtttgcattctcagatgttttttatatgaacgacacccgttgcggtcaaggaatagaagtgtggggaaatttggttgaagaagacatggataatttccaaaggaacttgtccaagctcctagaaaggatttgaatccatttcattagtgtcgcttattaaggaagtatcccttgcgtgatttttctgttatttctggtgtaacaattatcctgtgacaagttccggtagctaatagatgtccaaatagtttttctttatgttcttgataatctgttaactctgcctagtgtaagaggaggcatcttgtattgttcttctcaggtaatgaaaacatttcttcagtgtatgtctctgctatggtacagagcagaaacaaagtttgatttta

SEQ ID NO: 247 - DNA, 1348 bp, Papaver bracteatum
acaacacttgttttatttcagtctccaaagaggtttgacacagcatatcaaatcaggcaatgttcttgtaaacaacaatcaggaagatatggcaacaatgtctagtgctgctgttgaagtgatctccaaggaaatcattaagccggcaactccacccccatatcaacttacaaacttcaacatctcacttttcgatcagtatatgcctccaagttatactccggtcattctattttaccctgcagccgtcgctgatagtaccggcggtagtaagctccatgatgatcttggcggcttgctcaagaggtctctttctcaaacgctggttcacttttacccaatggctggcaggttgaaagataacatggttgtcgactgcaacgaccaaggggtcgacttttaccaagtgaaaatcaaagctaaaatgtgtgacttcatgatgaaaccagatgagtttcccttaagtctgcttcttccggccgacgtcgtttccgtgaattttgttaaggaggcacaggtgattgttcaggtgaatatgttcgattgtggtggaactgccatttcgttgtgtatatcacacaagattgcagatgcatgcacaatgagtacattcactcgtaattgggcagccaccaccaacacagctcgtcttgggggagctatcggtcctccaaacacaaatccgttgtttcttccttctttcgactcggcatctcttttcccacctaacgaacaattggcatctcaatcagcgatgccatccgttacttatcctactgaggatagccgaagacatatagttgtcagcaaaagatttgtgttcgatgcggtaaagttaaaatctgtacgtgaaaagctacaagtattgatgcatgataaatacagatcccgtaagccaacaagggttgaggtggtttccgctctaatatggaaggcagccatgaaatccgctccgtctggtgcttcatcgacggtaaaccatgccgtgaactttagaaagaaaatggacccacctttacaagatgtgtcattcggaaatctttgtcaggtcgttgcagcattattaccagcaacaacgccggaaacaacagtaaattcagataacaagacagttaatagtacaagtaatgaagtgcaagtggcacttgatgagttaaatgatttcgtagctcaattgagaggcgaaatagataaggtaaagggcgacaaaggttgcatggagagaatgtttctaaatttcatgaatggttacgtaacgaaagacagtgatgttgaagatgaagtgatagctttttggatgactagctggtgcaactttggtttatatgatgctgatttcggttgggga

SEQ ID NO: 248 - DNA, 1572 bp, Papaver somniferum; identical to SEQ ID NO: 5

SEQ ID NO: 249 - DNA, 1919 bp, Sanguinaria canadensis
caatgaacaacaggaaagtaattagtacgagtcaatatcagttcatacaagcatacatacgtaagaattgagtgacatgacatttgattttattgcgggaaaacaaagaggagttcatgagctgctcagtccaacaaagtaacgaaatcaaggagttcctgatcgcgttcgaatctagccatgtcttcctccaacaagcaaatccaggcttcaattccatctcctgttctgtcatccatcaaaagagaggtgttcttgaatggcagactagcaacagctacccaattcggcttcccccaaccgaaatctgcttcatacaccggaaatctacaccagctagtaaacctatatagctccaattcattcccatttgtttccaatgccatcttcataaactcttgaaactttatgaaccctccatcaccttgaagcaccttcaaggaatcgctgttgattttacgtatcgattccctcattggacccagcagatccatctctccagtactctttgttatggatggtgccactcttgcaactgttgtcgcgagattcccaaatgattgctctggcaatggtgggtccagccttctcctcatgtccacaataatgtttgcaatcgatggttttggggaagaagttgctgccatggcagttttccaaataagtgcagtcacagcctccactcgtgtgggcaaattcttcttcttcttcttctcatcattggaattaccatatcttgctcgaagggttgctattttggtgccatcaaacacaaacctccttgtcactctcttttcggcttgtccagcttgtaccttactggtcaaatgcttattaattgcaccagaaaagggtgaggacattccttctctgggtggatacagaatagctgaatcaaaagtcggactgacaattgattcggggattgcctgacgagtgatggaagcccaagtattgataaatgtggtcaatgttgctgcgtcggctagcttatgtgaaatggaaacagaaattgctattccaccacagtcaaacaagttgacttgaacgatcaaatgtgaatcgttaccaacaattacattcaaggtagattggaaatcataaggtaggagatgatgcagttcatctcgtttcataaaatcagaaattttaccgttgactcgagattcgaaatactcaataccttcatcgctacaatccaccaagagcttatctttgatccttcctgctaacgggtagaagagggtcaaggtctccgatagagacttcttgagctgattagatacacctagctgatgatcatcatcaagagtagttgtgggactagagtagaagagaatgatggggacaaaaactggatgagcgagctgatcaagaagagacagcctgaaggttcgaaggtgatcgggggttggagttgcccacaaaatcgaattcaaagaaggccctgctttgcctgttcttgatcaaatgcttgaagatggaaactatcatggatcgtacgatttcatcttcgttgatgctgataaagataattacattaattaccacaagagattaatcgatctagtgaaaattggaggagtgatcgggtacgacaacactctatggaacggctcagttgtggccccaccagatgcaccattgagaaagtacgtaaggtattacaaagactttgtgttggaactcaacaaagctttggctgctgatccaaggatcgagatttgtcaactccctgttggtgatggtatcactctttgccgccgtatcagctaatcatttcccatcacataaaaaatatcccgggaaaatttttattttcccttcgcaaatattttcctttttaatttgtgtcgtgaatgaatgattagggttgcttggttaagtcaatgactcgcacttccacttgtatttttttt

SEQ ID NO: 250 - DNA, 1634 bp, Stylophorum diphyllum
tgtgatgtaattaagaagtccttgacgtaccactaagccagaagatcggaacaccatggaaatgaaggtcgaagtggtgtcgggagagaccattaaaccatcttctcctacttctcaacaccttagaaccttcaacatatcctttcttgatcagattgctccccccatttatattcctctcgttcttttctacacaaccaacggcgatagtgacagtaagtctcgttgtgatgtaattaagaagtccttgtctgagagcttaactagattttatccgttagccggaaagatcaaagatgagggttctgttgactgtaacgatgatggtgttgattatttggaagccaaagtcactaatagtcgactctctcatgttatacaacaccccgatgtccatgcacttcaacaattcctgccatgtgagccctatagttctgatcagtccgcacccaattcgaaagttctcctagccatacaggtcaacgtttttgaggattgtggtggaatggtgatcggtatttgcatctcgcacaggctagctgatgcatcttctttgagcacttttattaacgactggactgcgaccgctcgtggtgctactgagcaaatcaaggctccttatttcaaattgccaactctattccccaaggtagatttaaagggttttactcctccaggaggtatcaagaaaaaccaccgaaaaattgtgacaaagaggtttgtgtttgaggcctccaagatagctgaactcaagaaacaaagtggaaaattagccaatactaatatcaatggcggatctgataaaattcaagagtacccaacccgtgtggaagctttgtcggctttcatttggaagcgtttcatcgaattggatcaagctaaagaaggagctacaacatctgcaagggagtattcgttgacacatgcagtgaatttgaggaaaaagacggttccaccgttgccaacagatgcttttggcaatatgtacagttctacgtttgcagtgctcattgacaccgatggcaagtatgatcatccgtacccaaacttggttggaaaagttagagaggccatagagagaattgatggttttcatgttagaaaactgcaaagtactgatgcatacttcaatttttacaagaaacggatggaaaacgctgtttcgagtggtcagataccaaaagtgttgctacactttagtagttggtgcagattctctatatatgaagcagattttggatggggaaagccaacatgggcaacaactgctccactcccattcgagaatgttgttgtgttcatggacacgagatcaggagacggaatagaagcatgggtgaacatggttaaagaagacatggatgaattcgaatgtgacaaggaactctgctcgtttgtttcttagtttcctagtcgacccaaaaactcgatagtaacttaattctcattcaaacgagtctgatgagaagatctatccatattcaagaatgtatactagctgttaatttcctgctaaagtttttcaaatttcttcgctacaacggtttcttttcctatgttttgatgtccttagttttagaaatattactctgtgattgatatttgaatattgtgttactctgtggttgatattt

SEQ ID NO: 251 - DNA, 665 bp, Stylophorum diphyllum
aacggatggcatcgctgattgagatgccaattgttcgttaggtgagaaaagagatgccgagtcgaaagaaggaagaaacaacggatttgtgtttggaggaccgatagctcccccaagacgagctgtgttggtggtggctgcccaataacgagtgaatgtactcatggtgcatgcatctgcaatcttgtgtgatatacacaaacaaatggctgctccaccgcaatcaaatatgttcacttgaacaatcacctgtgcttccttaacgaagttcatggaaacgactccagatgggagaagcagacttaagcgtacatctggattcatcatgaagtcgcacaaattactcttgatttttacttcgataaagtcgatgccttcatcgttacagtcgactacaatgttgtctttcatcctaccggccagtggataaaattgacccagcgtttcagaaagagaactcttaagcaagttaagatcatcgtggtgtttactaccagaactattagtgactgcagcagggtagaaaagaatgattggaacataaactataggacaatattgatcaagaagggacagattgaagtttctaagttgatatggggttggagttgtgggtttaattgtttccttggagattcacttcgacatcaacactagaacaaagc

SEQ ID NO: 252 - DNA, 1792 bp, Tinospora cordifolia
cgggatcaaatcgaacttattacatcaattttgttcaatttttaggtttagtcaattttgttgaacacccctaattctaaaaatgaaaaaaccgacttcccaaccaaccatatatagatgatatacatagatagtgcaataagaacaaagcactgcaaccattgtttcaaaattgtagttaaagatacttccctgttaaaaggacacaaaggagaggaactcttgatcatgttccaactcatccatgtcttcttccaacatgttcaaccatgcttctattccaccaccacatcttgtgtctatcaaaatgataagattcctaccaagtgtcttggttgtgctaacccaaacaggctttccccacccaaagtctgcttcatagaaagggaacctacaccaactgttgaagttcaacacaagtagctcctcctttgagaagtttttccttgcttcttcaaatgatttcacgaacccttcttctccacattgaagtttccttacataatctccatccattccccttattgcatctctcaaatgctttaccaaggcatggctttctgtttcactctccaagttcacaatttctgttattgcaggtctagaagcattcccaaatctatgatttggagaagcaggcaccatccttcccctcaaattcactgcatgaagtgctgcagatgcccttaaaggtccagctcttgcccgagcagctcttattgcgtgcttccatatgaacgccgaaactgcttctactctagttgggtactcctcctttgagtttttcttagagttattaaaaattatttcacctcttagagcatctatcttcttgccatcaaatacaaaccttctggtgacgatgttgtctaccattcccaccccacttggagctattaatccatttgaatctttcgccgggaagagcgaagacaaatcaaagaacagatttggaatagattcagtggatccattaatagcagtggaagcccaacaatttataaatgtcgccattgatgcaccatcagcaatcttgtgtgaaaagcagaagcctagagcaattccaccgcagtcgaagtaggtggtttggatcgctaggagtgaattggagcacagtgcttcattagtcgtcacataaggatcacacggaaggaatttactgagttcatcaatgttgggtcgtatgagaaaatccgacagtctagtattcttcactctagcttccaagaactcgactcccttgtcgttgcaatcgagggtgacgccgtttactatccttccagccactgggtagaaatgggtcaaggtttctgataaagatttcttgagctgatcggatctctttaagtgttctacttgatttttgtcttcatcagtactgtaaggtggatagaagagaatgatggtgacatagttagaagtagcttgctgatctaaataggagagtttgaaggatttcaggtgatcaggagttggagttgatggtgaaactttgtctcttgagatgatctgaatctccatttctcttgcccataaataaagtcgtgatcattaaaataaagctatagagtgattgagctaatggttggagatcaagcaaccgcaggttcacgtaaattagtaggaacaaaagccgccaagaccacgtaattttcaaaataaataataaataaataaaggcagagaacagggaggaatatgagtaaggtacgaggatggcagcagagaagatcagagagcatttgcagagatggtggaaaggttatcctaatcctctctctctctctctctc

SEQ ID NO: 253 - DNA, 1444 bp, Thalictrum flavum
acaaccaacatccacaatcgtgatcatcaccttttcttcaatactacttacaaattacaacaatacatagaattaatgaacccataatgaacatctaattgagttctaagccagatttggctgaagtgaaggtaatgatgtcaggctcacactcaaaactagccatgtcttcttcaatcaaagaaacccatgcttcaattccattgccacaattagtatccattaacataatgatgttcttagcaaccaagttaacactggttaaccaacttggtttcccccacccaaaatctgcttcatagaaagggaacctacaccaactggtaataacgtaagcttccagttcacctttgacatccatttcaaagaaccttatggtagaatcataaagctcggaaagcccattatcagattgaagttttttaacatagccactgtcaatactccttaacccttttcgtaactgactcaccaaggaatgaaatttttgctgtatatctgtgcttgactctactgacttaccaatcattagatttccaacaaaatcgttagacaaaggtggatccattcttccgcgaagattcactgcaaagtttaccacagatgctgatgaccttagggactttgttctcattcttaccgcattcatggcacatctccatatgagtgctgaaactacctctaccctcgttgggttttcaattgcatctttagttatagctctgagtgccgcaatattagacgcatcaaagataaaccttttactgacaaccttgtgtggacttcctatgggaggcataggagatggtatatctttgggagggaacagagatgtcatgttaaacttgggatggagtagtttactatctccccttgaaagggatgcccaattattgaggaaaacactcatagaagagccatcaagaagtttatgtgatgtacacacagcaagtatcattcctccacaagagaagatattcacttgaatggatagtaatacctttggacccaatccatagaactcatctattcttgggagtaattggtctagctcctgaggtataggattgttcagaacttgcttgagttcaccactaattcgggcttctgaaaagctgacaccctcatcactacaatcaatagcttcatgaccagtgatccttcctgctaatggataaaattgtgttaagacctcagataaggattcctttagacgattagtatgtgcagtattttcgactttgttgtgttcattggcagagtagaatagtaggacaggcacatgaactggaggagcgtattgatctactagagatagttgaaaagttttaaggtgattgggtgttggagaagatggtttaatggtttcttcagagataacctcaacattaagtgtcatcttgttccttatgaatatttctagtagacataaagatggaagctc

SEQ ID NO: 254 - DNA, 1486 bp, Xanthoriza simplicissima
caaatattcaaatgagaacacaaagggcaaaatgacactggatattaacgttctctctcaagaaactatcacaccatcctcttcaacacccaatcacctcagaaacttcaagctctcccttgtagatcagtatgctcctccagtgcatatttctgtcattctattttaccctgccaacatcaatgacagagtaaaaattgatgagcgaactcatcgtttaaaaagatccttgtcggagatcttaactcatttctacccgttaggtggaaagatcaataataatcaatttatcgactgtactgatgagggagtcaacttcttcgaaactcgagttaatggtcgtcaactgagccaagttctcaaccatcctataccagaggagctggagcaattacttaacaaagatgacttctatagattgggtccaaaggcactgttatccattcaagccaacatctttgactgtggaggaatggcacttggtgtttgcatatctcacaaagctgccgatggctcttctttcggattattccttaataactgggccgccatcacaagggaggacaacggaattcctcaaccaatacttggccagacatcgcttttccctcctaaagatgatgtgttctcttatgtacctgccggtgtaagctcaataccaaaggttgttaataaaatatttgtcttcaatgcaggaaatatagctgccctcaaggctaaagcttcccacaaattatatgtagaacaccctacacgggtagaggcagtttctgcactcttatggcggtgtgcaaggaacgcgttaagaacgagacctggatctgcaaactcagcatctgtcgcgactcttgcaatgaatctgcgcgggaacatggttccagcgttgtctaatctctctttcggaaatctcatgattggtacaatagcaacatcaaatacggaaagcgccccagagttgccttgtttggtgggtgagttgcgggaagcgaaaatgaaagttgacgttgattatgtgagaaaacttcaagttgatgatggagtttccgagttatggaattctttcatggatctgaatgcacgacatatcaaaggtgaactggaactttacacaatttccagttggtgcgggtttcctttctatgaagctgatttcggatgggggaagccaatgtggataacctctgttaatctgtttgccccgaatattttcattttaatggatagtaaatgtggcaatggagtagaagcatgtgttaccttggatgaagaagttatggctagattcgaatgtgagcctgagctcattgccttcacttccaccactcgatcagctgcctgaagattgtaatatatagaccatattcattatgtcccatatttacttggtaatgaaatgtagccatattgcgatctctgatgaatttcatggtttatctttgccgatttggcttgctagattattatggtgagaactgaaaacagtcac

SEQ ID NO: 255 - protein, 459 aa, Argemone mexicana
MSDIMKVEVVSREIIKPLSPTPNHLKTFNLSFLDQLSPPIYVPIILFYPIDCKNDCKSTIESIRGNLKKTLAHTLTKYYPLAGRIKDGSFVECNDDGVDYVEANVYDINGGISEIIQNPDGDILKKLLPFDPYGVEGYNTKVLLSIRINVLEENCGGIVIGICISHKIGDGSSLTTFINDWAAAARKNPSEQIKGPQFDLPSLFPLRDLKGYIPPSAGAEMVEEIVTKKFVFEGSKITELKKKGIVNGGNNDDDDVKKYPSRVEAVSAFIWRRVIGLDQAKKQGGDSNNEAPVTVYGSLHAVNMRSRMNPPLPSNSFGNMYTTTMAFSIINNHADEEEKLGHYQLPNLVEKVKESIKKIDSEYVKKVQTTDELLNSMKHLATGHQMVMLSFSSWCRFPIYEADFGWGKPIWVTTSTFPFKNVVVFMDTKSGDGIEAWVNMTKDDMAAFERDQELLQYVS

SEQ ID NO: 256 - protein, 446 aa, Berberis thunbergii
MKMKVQVISRESIKPSSPTPPYLKTFNLCFLDQIAPPFYIPIFLFYADNSPNDIENAGLHCRQKRSLSETLTSFYPLAGRINGNTSVDCNDEGANYVEARVSGLLSEVIVQPNVADVLKMFSPCDEPHFDDADTAHGPKFGSKVLLAIQVNVFDCGGIMICVCLSHKISDAYSMSKFINCWAAKTHNCKEEILPISELSSIFPQRDLLGYIPSAFIHRGKGKIVTKRFVFDASKIASLRATGANSSHVSYPTRIEAVSALIWRRFMESTRAKNGLLKEYVAIHAVNFRRRMDPPLKVEGLENTLGNVFGSTFTASQDLDGKKEPHILVSKLRDAISKIDGKYLRRILCGNAYLESFLGGLAGVAKGETGLAIFSSWCRFPWYETDFGWGKPTWVSISGFPCRDLIILMDTRTGDGIEAWVNMLDEDMAEFEQDEKLLEYVSTTPSA

SEQ ID NO: 257 - protein, 464 aa, Chordyalis celanthifolia
MEGSSPITTASKAGNKLEMADSKSSSVVEVISKETIKPSIPTPEHLKTIKISLLDQLSPPLYVPIILFYTAAAATDDDDKEIYENLEYKSNILKKSLSETLTHFYPLAGRMKDNMVIDCNDEGVDYFEARVSGNMSEFMKPDAVPQFLPYDVSCNYSGNGKIQLGVQVNKFDCGGIAIGVCISHKTADASSMSAFINGWASTARTGATESPTFDLVHLYPPSCVQIPSENSFTTQVEGEKVVTKRFVFDASKIANLRAKLGDDDDDKKTITRVQAVTGLIWKCAMSKWAHTSSSTSSKLSIANLAVNIRWRMDPPLDQLSYGNLLTLATAASTTEGGSLEELVGQLKVALSKIDAETIKYIQGEGGFMRLQELLGRVHEMFAKGDEVEVYMFSSWCRFPVYEADFGWGRPTWVSCSSQPYKNTVILMDTRSGDGIEAWVNLVEDDMTLFQQNQELLEFVSYTDI

SEQ ID NO: 258 - protein, 270 aa, Chelidonium majus
SFDSTSLFPPSEQLASQVSYPTQDSTSVDKLVSKRFVFDAAKITSAREKLQSLMHDKYKCHRPTRVEVVSALIWKSAVKSAPPGSISTVTHAMNFRKKMDPPLQDASFGNLCVVVTAVLPATTATTTNPATKKVSSTSNEEQVALDELSDFVALLRREIDKVKGDKGCMEKIIQKFIYGHDASVAKDSDVEDKVTALFMTSWCKFGFYEADFGWGTPVWVTTVPLIEPKYKNMVFMNDMKCGEGIEVWVNFLEDDMTKFEHHLREILQLF

SEQ ID NO: 259 - protein, 471 aa, Chelidonium majus
MIKMDPKIKVVLISNETIKPSSPTPHHLRNFNFSLIDQFSSPIYIPIILFYDQVIDSNIDDDHRSNRLKRSLSETLTRFYPVAGRINGNVSIDCNDEGVDYFETRIQGKMSDFMVRPELYNHLLPSHIVSNIFATDAQLAVQVNVFDCGGLAICFCMSHKIADASSMTTFINDWAATTRGSMAESVGPIFESASLFPARDILKTSIEPVPDTAGVDVVTKRFVFDASMIAALRAKIQGTTVTSVGKYPTRVEAVSGLIWKSTIEMSKVKLESGSSTKPLKAMVVHHSVNLRKRMDPPLADVSFGNIITLTSAVASSTMIMSQEVELEELVGKLRAAISRINISDYINKMLGCDDDDEEFVRLLKVSNRFAKEVNNDDHVDGEDNTDTDADSNADDDDVYWMSSWCRFPVYESDFGWGKPTFVCTKQSYKNVVILMDTRCGGGIEAWVSLVEDDMAIFERNPNLLQFVSTIN

SEQ ID NO: 260 - protein, 427 aa, Chelidonium majus
MVLKVEIISKETIKPSSPTPIHLRSFKLSFLDQITPPIPFNILFFYPASDGSFDNVKRSDRLKKSLSETLTYFYPLAGTIGDNITVQCDDNGVQFLETQVNCQLSKVLKHPEAQVMKQFLPDPGMMCNELGKGLQLAIQVNMFDCGGMVIGMTVLHKIIDAGSLSTFINAWARTARGTDETLGPRFDSASLFPPNEVPGTTFLPMKMNPNSAEKIVTKKFVFDASNIAALRAKASHSEHVKNPTRVESVSALLWKCAWNAKSKSSVANVIVNFRSRIVPPLPENSFGNLIGMSTTKITNHEEAELHYLARNLRDAIRKINNDYMKELQNDGSLRSTLEAPHEEFNNDEVEVYTMTSWCRFPFYEVDFGWGKPIWISTVNLLVKNGFMLMDTRCGSGIEAWVTLDEQKMAEFESDLDRASQIHFSQNQ

SEQ ID NO: 261 - protein, 434 aa, Cissampelos mucronata
MEVQIISRENISPSTPVDPHRENSLKLSLLDHLATSNYVTIILFYPSGCGVGNHEDHISKRSDQLKTSLSETLTHFYPVAGRIRDGAAVDCDGQGVEFSEAKAGVRLAEFLKRPNIDDLDKLLPCAPYVTNEELPAKALLGVQANYFDCGGMALGVCFSHKIADGAAMATFIRFWADAANGSSKNALPNPSFDLPSLFPAKDSDGATPSGRGGVGEGSNIVTRRFVFKGEKVAALRGTEVEHPTRVEAVSAFIWERAIAATRAKAGPERASIAVHAVNLRGRMVPPLPSNAFGNASRPTITKCVEFGSDTRSDRHVLVKHLRDAMRRVDGDYVRKLQCGEEGFMNSIEEIQKQFSKGEVVAMNFNSWCRFPFYDANFGWGRPIWVSTTKTPGKNLVILIDSKFGDGIEAWLNMVEEDLVELEKDEEFLSFVSNT

SEQ ID NO: 262 - protein, 459 aa, Cocculus trilobus
  misc_feature (249)..(249): Xaa can be any naturally occurring amino acid
MSTLIKKNLSSSFWFQVVELGESVAMDQKSSNGNVFELSVKVGEPTLVPPAEDTPKGLYFLSNLDQNIAVIIRTVYCFKSEEKGNERAGEVLKDALAKVLVHYYPMAGRLTISSEGKLIVHCTGEGGVFVEAEADCKMEDIGDITKPDPVTLGKLVYDIPGAKNILEMPPLVAQITKFKCGGFVLGLCMNHCMFDGLGAMEFVNSWGETARGEPLTVPPFLDRSILKARIPPKIEFTHQEFAEIEDISXTSSLYEEEMLYRSFCFDTQKLEQLKKKAMEDNVIAKCTTFEALSAFVWKARCEALKMKPDQQIKLLFAVDGRPRFEPPLPKGYSGNGIVLTNSLCNAGEVLENPLSFTVGLVQRAVKMVTDSYMRSAIDYFEVTRARPSLAATLLITTWSRLSFHITDFGWGEPILSGPVTLPEKEVILFLSHGKERKSINVLLGLPASSMKIFQELMEI

SEQ ID NO: 263 - protein, 430 aa, Eschscholzia californica
MAVMMDKLVRVISKEIIKPSSSTPSHLSPYKLSLLDQVIYPVYVPVVLFFESNHTNSFESESNYHHLLKKSLSNVLTRYYPLAGRIKDNIFVECNDLGVDYFEAKVNGNITEFRSADLLNQLIPTLDMASRTPLIIQVNMFDCGGIAISMCMSHKLFDASSIATFINCWAATARGETEFVIPNFDAHSLFSVRQVSFPVPDTPVELKDGTIENKLVAKRFVFDAANIASLRARIAKTSNGKYPTRVEAVSALIWKSLMNPEAESMSILNQAVNLRRKMDPPLTQESFGNIVTLATTTLIPKNSYSLDELVGHLRVSIHKIDEDYVRKLRGDSGEEFIKWVTKEAGLMNEDGKNMYMMSSWCRFPFYESDFGWGKPVWVTYSVGQALAKNGIVLMDTRDGEGIEAWVKLEEKDMTAFECNENLLEFAYVTK

SEQ ID NO: 264 - protein, 467 aa, Glaucium flavum
MTYAALPYPLRPCPFTPLDQFSSPHYVPIILFYAAAAPLGDCPTEGNQVDDIDHRSNRLKRSLSETLTQFYPVAGRIKDSSSVDCNDEGIDYYETRIHGKMSAFMTRPREHHHLLPCHIASNILAKDAQLAVQVNVFACGGTAISFCMSHKIADASSMTTFINDWAATNRGSTKTLSPTFKSAFLFPPREILNTLAVPGPDTHGIDNRTIGDVNKAVVTKRFVFDASMIAALRAKIQNTSTPRVGYFPSRVEAVSALIWKSFMEMSKVKKLKIESSSLRKPVKCMVVHHTVSLRKRMDPLLADRSFGNMITLATAVASPTMLMAKQVDVEELVRQLRAAISKINGDYIKKLQSGGDDDEEFLRLVNESGRFAKKVNNGDEVTDHNDDSDDDHEVYWMGSWCRFPLYESDFGWGKPVMVSSYQSYKNVVIMIDTSCGDGIEAWVSLVEDDMAVFERDAQLLEFASTIC

SEQ ID NO: 265 - protein, 449 aa, Glaucium flavum
MKMKVEVVSREMIKPSSPTPHHLRTFNLSFLDQLAPPIYVPLVLFYKSDEYDNDNNSHFPDIIKKSLSASLTRFYPLAGRIQDEGSVDCNDEGVDYLETKVTNGELSQIIQHPEVHVLQQFLPCDSYSTNQSTPVTSKVLLAVQVNVFEDCGGIVIGICISHTLADASSLSTFINDWAACARGATDQIMDPCFELPTLFPKVDLMGYNTLGSIKKNKQQIVTKRFVFEASKITELKKQSVVETNATNINGDGHRECPTRVEALSAFVWKRFMKLNQAKEEASARVYRVTQAVNLRKRMVPQLPTNAFGNMYSPTFALLVDAEGKGDHPYPTLIVKIGEAIKRIDGDHVRKLQHTDAYFNFYKKQMENAASNNQTSNVMLHFSSWCRFGIYEADFGWGKPTWAATAPLPFKNVVVFMDTRSGDGIEAWVNMTKEDMDEFECDKEFLKFAS

SEQ ID NO: 266 - protein, 487 aa, Hydrastis canadensis
MDQTQQFHLLRVTFQKILGKMTLNVEVISRETIKPSSPTPHHLKNFKLSHLDQYTPPIGVPIILFYSANHFEKTKMSDRLKKTLSKTLTDFYPLGGKIKDNNSIDCDDSGVEYLETQVKAQLYQFLNCPEADELNQLIPLNLNCTGMSSEIQLAIQVNVFECGGIAIAACISHKVADASSLCTFLSNWAANARGANHVVFPQFDSAPLFPPREVSSLQLSTEGPTHNVVTKRFIFDSSNIAALKAKSANYVENPTRVEAVATFLWRCFMNVASLKPGSIKSFMVNIAVNLRSRMVPPLPDHSFGNLIMAAMPSSTADSKAELHCLVGQLREAIRRYDGDYMKNLQDGDGVSMFYDSMRQAIELFAKGEMGFYTITSWCRFPFYEIDFGWGKPIWASSLNMVHKNVVILMDTKYGDGIEALVTLDEEDMARFECEEELLAFTSPKNIAYVQELHDFTNPIKMAYEQEVLASTSPNGMAYEKRSLISLG

SEQ ID NO: 267 - protein, 439 aa, Jeffersonia diphylla
MSIQVEIMSRESIKPSTPTPPHLRTFKLGLFDLLAGFDRVSILLFYDNKDTKKIEFSDISRRLKTSLSETLSSFYPIAGRMNGYIAIECNDEGVDYVEARVKAQLEDVIKHRNVDQVLELLSPGDDQEPQLSLKVLLAIQVNLFECGGIVISVCLSHKISDAYSMITFINSWAAKTSDSNQLIHPISQQLSSLYPPSGLDLNSAPFQSTIPNLVTKRFVFDSSNIASLRAEVINNNSSCVPSPTRVELVSALLWRCFMELTRKKNGFLKECAAMHIVDLRKRMDGKGLENALGNLCAPTFTTSRELASENELYVLVGELRDAIRKMDSEFVTKIRRDGEYIQHLEDEYSKGISTGKTGLIMFTSWCRFPLYKANFGWGKPVWATGISARNDFKNVVALMDTRSGDGIEALVRMAEEDMAEFEQDEQLLSFLSSTHCVDC

SEQ ID NO: 268 - protein, 430 aa, Mahonia aquifolium
MIVNIKETTMVRPSEPTPKRSLWNSNVDLVVPRMHTPSVYFYRPNGSSNFFDANVLKEALSKALVPFYPMGARLKRDEDGRIEIDCDGQGVLFVEAETVSVIDDFGDFAPTLELRQLIPTVDYSGDISSYPLLVLQITHFKCGGVSLGVGMQHHVADGASGLHFINTWSDMARGLDLTIPPFIDRTLLRARDPPRPAFEQVEYLPPPAMKTPLSTPTDSTSVAIFKITREQLNILKAKSKEGGNTINYSSYEMLAGHVWRSACKARGLPYDQETKMYIATDGRSRLRPALPPGYFGNVIFTTTPIAVSGDLSAKPLTYAASVIHEALGRMDDEYMRSALDYLELQPDLAALVRGAHSFRCPNIGITSWSRLPIHDADFGWGRPIFMGPGGIAYEGLAFLLPSPINDGSLSLAISLQSEHMKVFEKILYEF

SEQ ID NO: 269 - protein, 457 aa, Menispermum canadense
MKKMMKYMKVQVVSKETIKPSSPTPPHLRTYNFSLIDQHIPQLLYIPFILFYSPNIHHKDHDDDHHRQLINIQTQSLDRLKTSLSETLTLYYPLAGRIKNDSIICCEDEGVEFVHTKVIDSPLLELVNKAEPENLAQLLPRHDHQRNEKPPLLSIQFNAFECGGMAIGLWFSHKVADSSSLCTFLHNWASIARGSLSSTEILCPRFDCATHFPPKQLMSPLQHVKTKGEVVSRRYIFDASMIAALKAKASTTINRNSSSSISPSRVLAVIAFLWRTVIAMDREKQLGSIRPLNMGIAVSLRSKMELTLPELSFGNLVAIGMTSAFHEQEVVERIGDLFGKFNRDYVKKLQSGEEYLKLMESLGELEEQICRGEAERYGVTSWCRFPFYEVDFGWGKPVWANVAAFEDNNFFVLMDTRFGEGIEVWVSLGEDDMARFQRQLDRELLVLFNSFSSVGSA

SEQ ID NO: 270 - protein, 444 aa, Nandina domestica
MKVEKISRDFIKPSTPTPDHLRTFRLSLLDQLAHPVFVPIILFYSSPTTTLDDDHQLGVSNQLKKSLSETLTLFYPLAGRIKDKLLVDCSDEGIEYFESRVNGKISDFMKRDELHHLLPYDFQSTLNVIVGNDSHLIVQVNLFDCGGIAISVSISHKLADAATLTTFINTWASITRQAIPESIVSPTFDSAILYPPREGMSSPFSGAINKHLTSKVQAGQAEKRVTRRFVFDGTKIATLRARYGNSNDEKKKKKNLPTRVEAVTALIWKTAMAATSSPKPSIANIIVDMRRRLDPPLPEQSFGNLATTVARVAPSITKSTGEMDLLGPMRESIRKINSDSLKVLQGDGGFIKFQEFMKMALETNGNELELYRFTSWCRFPVYEADFGWGKPNWVAVASLPFKNTSLLMDDRTGDGIEAWICLLEEDMARFERDQELLDFVTLLD

SEQ ID NO: 271 - protein, 422 aa, Nigella sativa
MTPKVSVLSRETIKPSLPTPPHLRTFRLSLLDQYSFPVRVPVILFYFNDGENDHTKISKLKTSLSDILTHFYPLAGRIVGDRLINCDDSGVQYLEAQANTQLETFLKYPKADELNQLLPLKLHHNDESSETQLQIQVNTFECGGIAIAASISHMVADTATLCSFINTWAAKSCGCSKTMPPCFDSVALFPPKEIPSFQLPMGDQTQRVISKRFVFHSAKLAALRAKSVSKLEVENPTRVEVVSALVWKCLMNAATRRQGMSFTVNMAVNLRSRMVPPLSDNSFGNLIIGALPSAERGEALHCLVGKFRKMIKRDYSKLPENNGISIFHDGLRKTMEAAARGKIGMYTITSWCRFPFYEADFGWGKPIWATTVNVDHKNIVMLMDTKDGDGIEALVTLDERDMALFECQQELLDFAIPNSMVS

SEQ ID NO: 272 - protein, 482 aa, Papaver bracteatum
MILYSWDYMEALSSVDVEVISKETIKPTTPTPYQLRNFNLSLLDQYCPIVYVPIILFYPAAVTNSSGSKHHDDLNLLKSSLSETLGQFYPLAGRMKDNIVVDCNDEGIDFIEVKIKSKLCDFMMNPDVRLSLLLPSGVVSMNFVKEAQVIVQVNIFDCGGAAICLCISHKIADACTMSTFTRYWAATTNTARLGGAIGPPNTNPLFLPSFDSASLFPPNEQLASQSAMPSVTYPTEDSRRHIVVSKRFVFDAVKLKSVREKLQVLMHDKYRSRKPTRVEVVSALIWKAAMKSAPSGASSTVNHAVNFRKKMDPPLQDVSFGNLCQVVAALLPATTPETTENSDNKTVNSTSNEVQVALDELNDFVAQLRGEIDKVKGDKSCMERMFLNFMNGYDASETKDSDVEDEVIAFWMTSWCNFGLYDADFGWGKPIWVTTDPFIEPNKNIIYMIDTKCGEGIEVWVNFLEDDMAKFEHHLSEILELF

SEQ ID NO: 273 - protein, 526 aa, Papaver bracteatum
MILYSWDYMEALSSVDVEVISKETIKPTTPTPYQLRNFNLSLLDQYCPIVYVPIILFYPAAVTNSSGSKHHDDLNLLKSSLSETLGQFYPLAGRMKDNIVVDCNDEGIDFIEVKIKSKLCDFMMNPDVRLSLLLPSGVVSMNFVKEAQVIVQVNIFDCGGTAISVSISHKIADAATMSTFTRYWAATTNTARLGGAIGPPNTNPLFLPSFDSASLFPPNEQLASQSAMPSVTYPTEDSRRHIVVSKRFVFDAVKLKSVREKLQVLMHDKYRSRKPTRVEVVSALIWKAAMKSAPSGASSTVNHAVNFRKKMDPPLQDVSFGNLCQVVAALLPATTPGASPTVNHAVNLRKKMDPPLQDESFGNLCKAVTAILPATTTTTTTKNEDNKTINSTSNEVQVAVLHELNDFIAQLRSEIDKVKGDKDCMEKIIQNFMNGYEYATTKKKNDVEDEVITLWMTSWCNMGLYETDFGWGKPIWVTTDPNIKPNKNIIYMNDTKCGEGIEVWANFLEDDMAKFEHHLSEILELF

SEQ ID NO: 274 - protein, 516 aa, Papaver bracteatum
MILYSWDYMEALSSVDVEVISKETIKPTTPTPYQLRNFNLSLLDQYCPIVYVPIILFYPAAVTNSSGSKHHDDLNLLKSSLSETLGQFYPLAGRMKDNIVVDCNDEGIDFIEVKIKSKLCDFMMNPDVRLSLLLPSGVVSMNFVKEAQVIVQVNIFDCGGAAICLCISHKIADACTMSTFTRYWAATTNTARLGGAIGPPNTNPLFLPSFDSASLFPPNEQLASQSAMPSVTYPTEDSRRHIVVSKRFVFDAVKLKSVRDLLPSFDAATLFPPSEQLVCPSEVPPTPVSHHNDDSGGEKSVSKRFVLDAVKINSVREKLQGLMHDNYKCTSRPTRVDVVTALVWKAAMKSAPRDGFLPMVNHVMSFRKKMDPPLPDASFGNLCAVVSTAVSPGATATSTNDEVLEEQLAELVAQLRGEKYKVKGDKGCIEKIFLSFVGGDNALWMASWSKFGFYDADFGWGKPVWVTTDLSVVEPNQNLICMIDTKCGEGIEVSAKFLENDMAKFEFHLSEILKLF

SEQ ID NO: 275 - protein, 457 aa, Papaver bracteatum
MNQFVILKQPTMSNIIVEVISKETIKPSTPTPHQFKNHSLSLIDQYIVPSFVPLIFFFPAVPGLYDHTAGNKQHGDNILLLKRSLSETLSHFYPLAGRVKDNIVVDCNDQGIEFIEAKVSGSMSEFLKKPDDHLSGLLPSKVVCMNYVTNTQVFVQVNSFECHSTAICLCVSHKVADVATITTFIRCWAQTNISVSRTTSIGSKLHPTFDSASLFPPIKQLVSPTMVTPTELDSTPLEESKSISKIISKRFVFDAKMINSVREKISATMVDKYKSRRLSRVEIVSALIWKSFVKLATPGSSSVIVRHAVNLRRRIDPPLPDVSFGNILEFTKLVVGSASTTTQGTSKLHEDLNEFVCQLRESISKMNKGDHDFDMENTENEGRNLWMSSWGSYGSYDIDFGWGKPIWVTTVGPMFAFSDVFYMNDTRCGQGIEVWGNLVEEDMDNFQRNLSKLLERI

SEQ ID NO: 276 - protein, 447 aa, Papaver bracteatum
MFYFSLQRGLTQHIKSGNVLVNNNQEDMATMSSAAVEVISKEIIKPATPPPYQLTNFNISLFDQYMPPSYTPVILFYPAAVADSTGGSKLHDDLGGLLKRSLSQTLVHFYPMAGRLKDNMVVDCNDQGVDFYQVKIKAKMCDFMMKPDEFPLSLLLPADVVSVNFVKEAQVIVQVNMFDCGGTAISLCISHKIADACTMSTFTRNWAATTNTARLGGAIGPPNTNPLFLPSFDSASLFPPNEQLASQSAMPSVTYPTEDSRRHIVVSKRFVFDAVKLKSVREKLQVLMHDKYRSRKPTRVEVVSALIWKAAMKSAPSGASSTVNHAVNFRKKMDPPLQDVSFGNLCQVVAALLPATTPETTVNSDNKTVNSTSNEVQVALDELNDFVAQLRGEIDKVKGDKGCMERMFLNFMNGYVTKDSDVEDEVIAFWMTSWCNFGLYDADFGWG

SEQ ID NO: 277 - protein, 437 aa, Sanguinaria canadensis
MNSILWATPTPDHLRTFRLSLLDQLAHPVFVPIILFYSSPTTTLDDDHQLGVSNQLKKSLSETLTLFYPLAGRIKDKLLVDCSDEGIEYFESRVNGKISDFMKRDELHHLLPYDFQSTLNVIVGNDSHLIVQVNLFDCGGIAISVSISHKLADAATLTTFINTWASITRQAIPESIVSPTFDSAILYPPREGMSSPFSGAINKHLTSKVQAGQAEKRVTRRFVFDGTKIATLRARYGNSNDEKKKKKNLPTRVEAVTALIWKTAMAATSSPKPSIANIIVDMRRRLDPPLPEQSFGNLATTVARVAPSITKSTGEMDLLGPMRESIRKINSDSLKVLQGDGGFIKFQEFMKMALETNGNELELYRFTSWCRFPVYEADFGWGKPNWVAVASLPFKNTSLLMDDRTGDGIEAWICLLEEDMARFERDQELLDFVTLLD

SEQ ID NO: 278 - protein, 441 aa, Tinospora cordifolia
MEIQIISRDKVSPSTPTPDHLKSFKLSYLDQQATSNYVTIILFYPPYSTDEDKNQVEHLKRSDQLKKSLSETLTHFYPVAGRIVNGVTLDCNDKGVEFLEARVKNTRLSDFLIRPNIDELSKFLPCDPYVTTNEALCSNSLLAIQTTYFDCGGIALGFCFSHKIADGASMATFINCWASTAINGSTESIPNLFFDLSSLFPAKDSNGLIAPSGVGMVDNIVTRRFVFDGKKIDALRGEIIFNNSKKNSKEEYPTRVEAVSAFIWKHAIRAARARAGPLRASAALHAVNLRGRMVPASPNHRFGNASRPAITEIVNLESETESHALVKHLRDAIRGMDGDYVRKLQCGEEGFVKSFEEARKNFSKEELLVLNFNSWCRFPFYEADFGWGKPVWVSTTKTLGRNLIILIDTRCGGGIEAWLNMLEEDMDELEHDQEFLSFVSF

SEQ ID NO: 279 - protein, 449 aa, Thalictrum flavum
ELPSLCLLEIFIRNKMTLNVEVISEETIKPSSPTPNHLKTFQLSLVDQYAPPVHVPVLLFYSANEHNKVENTAHTNRLKESLSEVLTQFYPLAGRITGHEAIDCSDEGVSFSEARISGELKQVLNNPIPQELDQLLPRIDEFYGLGPKVLLSIQVNIFSCGGMILAVCTSHKLLDGSSMSVFLNNWASLSRGDSKLLHPKFNMTSLFPPKDIPSPMPPIGSPHKVVSKRFIFDASNIAALRAITKDAIENPTRVEVVSALIWRCAMNAVRMRTKSLRSSASVVNFAVNLRGRMDPPLSNDFVGNLMIGKSVESSTDIQQKFHSLVSQLRKGLRSIDSGYVKKLQSDNGLSELYDSTIRFFEMDVKGELEAYVITSWCRFPFYEADFGWGKPSWLTSVNLVAKNIIMLMDTNCGNGIEAWVSLIEEDMASFECEPDIITFTSAKSGLELN

SEQ ID NO: 280 - protein, 435 aa, Xanthoriza simplicissima
MTLDINVLSQETITPSSSTPNHLRNFKLSLVDQYAPPVHISVILFYPANINDRVKIDERTHRLKRSLSEILTHFYPLGGKINNNQFIDCTDEGVNFFETRVNGRQLSQVLNHPIPEELEQLLNKDDFYRLGPKALLSIQANIFDCGGMALGVCISHKAADGSSFGLFLNNWAAITREDNGIPQPILGQTSLFPPKDDVFSYVPAGVSSIPKVVNKIFVFNAGNIAALKAKASHKLYVEHPTRVEAVSALLWRCARNALRTRPGSANSASVATLAMNLRGNMVPALSNLSFGNLMIGTIATSNTESAPELPCLVGELREAKMKVDVDYVRKLQVDDGVSELWNSFMDLNARHIKGELELYTISSWCGFPFYEADFGWGKPMWITSVNLFAPNIFILMDSKCGNGVEACVTLDEEVMARFECEPELIAFTSTTRSAA

SEQ ID NO: 281 - DNA, 1150 bp, Argemone mexicana
acttcaaaatatgaatattcatcgatcaaacaaaaaccctaaagtttaatggcagaaaataattcttccattattactacaaatgtaactaatccctacgaatatctcaagatcgttcacaactcagaagacgatacactcactcggctcgatcctgtcccaattacaaacccaataacaaacgttcaaaactgcaaagatattcctctcaacattcaacacaaaacctggattagactcttcaaaccacctcaattacaacaacaaaaatcttcgaagaaagacgatgaattttctaaatcgttatcaaataaccaaagttttcctctaataatttacttccatggaggtgggtttataatgaatagtgcagcctcaaattatgaacatgttttttgtgaatttgtgacgactcgtatacccgcttttatcgcttcagttgaatatcgtcttgctccggaaaaccgactcccagcggcttatgatgatgcagttgaagccctaaattgggttaaaaaccaagccttggatacgattaatggtgagcaatggttgagaaattttgttgatttttctaaatgtttcattatggggtgtagcgcaggtggaaatattgcttatcatgcttgtttaagaacattagaattggatttggaaccaataaagatttctggtttcatattgaaccaaccttattttggtgggttaaggagaactgaatcagaattgagattgattaacaattggatgttgccgttagttatcaatgatttgatgtgggaattaagtttaccgattggtgcgaatcgagatcatgtttattgtaatccaatggttgatattgataattcatcatcaacaatattaggattagttaaaaaattagggttaataaggatgaagtgtttggttatagggtgtgatggagatccattgattgatcgtcagattgaatttgtgaagttgttgaaagagaaaggtgtaatggttgagagttgcattgaagaaggaggttttcatggggtgggtttttcttgtcctgaaaaaactgatgaattgtgtgtaaaattaaaagattttattttaggtacctattaatgtttgtatcagctcaaatctcaatcattgatttgaatctaaaattattttc

SEQ ID NO: 282 - DNA, 1089 bp, Berberis thunbergii
tatcattagcataaagcattccaaaagtaggaaatataatcacataatgatcctcttattcactcaatagacactttttatataaaaactggaaactcacagcggtcttactcagtagcttcagaggagtagacaaaatctatcaaggcagcaaacaatacctcagctttctgtggttcatacagttcaataccatggtacccttctttttcattgtcatcaaaccaacgcacaacatgcacacctttcctctccaacatcctcacaaactccatctgatgatccatcagtgggtccccactacgcacactcacaaaacaacgcttaattaatccattcttcttgtcatcatcaccatggatcattggattgcagtacttgtgatcacgatcaacccttcttggcaaagccaactcccacatcatatcactcattgataatggcaagatcttatcatcgaccaacctcagctctgatttagtcctttgagtcccaccaaaaaatggttgatttaatacgagccctctgatcttcaggggctcaatatccaaatctaatgcctgcagacctgcatggtacacaatgtttcccccagaactacatcccatcagaaaacatttggaaaagtcgccaaactccctcaacaatggctcaccatttaaattcaaagcttgatctctcacccaattaatagcttgcactgcatcattgtaggctgcagggagtcgactttcgggtgctagacggtactcaacagagagaataaaagcaggtagtttattagctaaggatgtacagaagtcatgaaaaatggtttgggctgcactgcacaaaatgaatccacctccatgaaaataaagtataattgggagcttatcaccattagtaattcgtggtgattcaatgggtttgaaaagcctcaaccaagttttatgagcagtgtttaggggtatgtcttggatgatagattgatcatcctcatatctacaagtaggggatatgagtctagtgagtgtatcgtccgaattgtgaacaaggccgagaaggttgtaagggtttatgggtgtttgggactgagattgatctaca

SEQ ID NO: 283 - DNA, 965 bp, Chelidonium majus
cgacttataaaagagagcagaaagaaagcaaaaaaaatgaaaaatccggtaaaacgaaaaattacatcagctagttcgtacacaatgtttcgtccaaaagctcattttagaaaaaataagaatttcattgtttaatactaataatatattttagtatataaattcgtcgtttaaaataaaatgttttagtttttccaaaaaggtttcacgtatcatagggtcaaagcatagcaccccatgataccctccttgttcaatccaagtttcaaccttcacacctttttcctccagcatcttcaccagctgaatttgtcgatcaataagtggatccccataaaatcctaccacaaaacatctctcgattaaccccaccatatttccagatgatgatccatcatgatcaatattcggattacaataaacgtgatcacgagtagacccaagcggcaacgccagttcccacatgacatcccttacggcaagcggcaagtcctgattgttgatcacttttgaatctgattcagttctctcaagactaccaaaaaaagggcagtgtaatattaatccattaatcttagctggttcaagatccatttctattgctcttaaactggcatgatatgcaacattagcacctgagctgcaccccataatgaaacactttgagaagtcaccatactcttttaaccatacttcactattatttagtttgcctaaaccttggtctttgacccagtttaaagcatcaacagcatcatcataggcagcgggaagtcggttttcaggagcaagacggtagtctacagaaacgaccagcgcgggtatatgtgtagcaatcgattgacaaaagtcatggttcatagttgaatctgcattgaaaagaatgaaacctccaccatggaaataaattatgataggaagcagcttattctttgttacaggaggttctttggttggtggccgaa

SEQ ID NO: 284 - DNA, 1420 bp, Cissampelos mucronata
gaaacatcaaaggcatcaaggatgccacgtgttctcagctcaagctcataataaaagccgcggccacctcgcaaaacggacgcgacgggcgcacacccaaacacacatcgccacatccgcctacaagttggccgtgccttcctcgagatgcgtttcgtagctctcggcgtaaaagacgcgactcgaggtgtgccagtccgcatcagtggtgtccgcagagcatttctgttccattaaagtaggtctctggcgtagctatgcatcaccatagtgggtggactggatgatgacaataaatgctgaactcattcgattccgatcgccaaccaacacagcccaaatcgaaacccaaattcgctctccaattctccatcaatggatccctacaagttcctcagcatctctcccaacccagacggatccctcactcgccacacccgaatccccacttccccgcccaccaacaatccaacagtggcctctgcagatttccctctcaacccctcgaacaacacatggttcagactctacaagcccacaaacacccccaccagcgcaaaggtcccgatcgtgatttactttcacgaaggggggtttgtgctgttcagcgcggcgtcgcagcccttccacgactgctgcgccgccttggcgtcccaattgcaagccctagtcatgtccgtggagtaccgcctcgcgcccgagcaccgcctcccctgcgcctacgacgacgccattgatgcgattgcgtgggtcagagggcaagccctcggcgggggcaatggttggtttggggattcggttgatttctcgaggtgtttcttgatgggtagcagctctggtggcaacattgtttacaaggcggggttgatgtcattggagaagggactaattggtggtggtgctgagcatgtgaagctagtaggactaattatgaaccagcccttctttggtggggtggagaggactgattcggagctccgctacgccgacgaccggatattgccgctgcccgcgggtgatctgttgtgggaattggctttgccgacagggtctgatcgggatcatgagttttgcaatccattaaagggtgttagtggtgagattgagaggctgcctaggtgctttgtcaatgggtattgtagggaccctttgattgataggcagagacagtttgcaaagatgttggagaggaatggagtttcagtggttgagcggtttgtcgatgatgggtttcatgcttgtgagctttttgatcctgataaagctagggctttggctttggcaatcaaggatttcatttatgattgtggtgctggtggtgcaaaatcagctctgtaatgttgtggaagaaagtatatataattatagttttattggtaattagtcggcatcccaagcttggcccgtgggcaagactata

SEQ ID NO: 285 - DNA, 1381 bp, Cissampelos mucronata
tctctctctctctctctctttttccctctatataaggagcttattggattccacatttgcaccactagagctcacaaaaattacctaagaaaacactgctactagtacttttctctccacatacttccaccaatattgtatgagaaacaaaagaatggctgctctctcctttgacaatgcaagattaggtcaccaagttggccaagatcatcgccaaaagccaggagttctaatcgaagagatcgatggcctaattcgagtttacaaagacggccacgtagagcgccctccggtcgttccaaacgttgattgtatagcgtatatcgagtcgagtttgacgtgtagagacgtaattatcgataagttcaccaatgtttgggcaaggttctatgttcctagaacccaagggacaaagcttcccttccttgtgtacttccatggtggtggcttctgcgttggctccgccgcttggagttgctaccatgaattcctaacaaaagtagcaaccaaagctggttgtgttatcatgtcggtgaattaccgcctttcgcctgagcaccgccttccgacggcctatgaagacggcgtcggcgccctcatgtgggtgagaagagagattcttagagggtctagtgaacaaaaatggtggtggagccattgcaacttctcacaagtgttcatagttggtgatagtgctggtgccaatatagctcaccatgtgaccacaagggtagggcaacttggggcttcatctgatgaacccaacattttgagccctatgactctcaagggcaccattttgattcaaccattttttgggggtgaagcaagaacgcattcagagaaatacatggcgcagcctcctaagtcagccctaaccgtggcggcatccgatgtttattggcggttgtcgctgcccttaggcgcgagccgcgatcatcgatggtgtaatcccattgcaaagggtgctatggatttggaagagttgagggtgcctccaattatggtttgcatatcagagttggacatattgaaggataggaacttggagttttgcagtgctatgaaaagggcagggaagagagtggagcatgtcgtgtacatgggtgtgggacatgcatttcaagtactaaaccactctcagctctctcaagcaagagctcatgagatgatgtctcacatcaaggctttcatcaaccgataatatatatattgttagtttttgtgttgattagttagtgtatagtaattagtatgagtacttcagtataaatatattgatcaagttcgttatatttggattgaaaattttgtgggaacgactagtatttttataatgtgttccccttgttttttcctttacaatttgctcaaaagaatt

SEQ ID NO: 286 - DNA, 1862 bp, Cocculus trilobus
aacgaataatataactaatgatattgtgtttacagagagtaagttagagagagacagagagaggattggaggatttttagagttttggtttggttagtggagaatgatgagaagttgtggagatgggagttttggggaagatcaatattgggttgttttagggtggttttttattttgttttgtgagtttgttctgtttttggaggtgattgaagcttaatggccggaagtaacgcggttaatgagtctcagagagcggttccactcaacacttggattctcatctccaattttaaagtggcatacaatcttcttcgtcgcccagacggcacttttaataggcacttggctgagtttcttgatcggaaagtgcctgctaatgtaatcccagttgaaggagttttctcctttgattgcttcatcgacagagctaccggccttcttagcagaatatatcggccagccccagctgatgaagctgaaattcttccgggcgtcattgatctcgaacgccctttaagcactgaggttgttccagtcattatcttctttcatggaggaagctttgcccactcctctgccaacagcgctatctatgataccctttgcaggcgccttgtgaggaattgcaaggctgttgtggtctctgtaaattatcgtagggcgcctgagaatcgctatccttgcgcctatgatgatgggtgggcagctctcaagtgggttcattcgaggccatggcttcggagtggagaggactccaaagttcatgtttacttggcgggtgatagctcagggggcaacattgcccaccatgtcgcaatgagggcagtggaagcaggaacagaagtaatgggtaatatactattgaatcctatgtttggtggaatggatagaacggaatcagagaagagattggatgggcggtactttgttacaattcaggaccgagattggtattggagggcttttctccccgaagggacggaccgagaccatcctgcgtgtaatccgtttggtcctaaaggcgcagacctcaaaggtgtcaagtttccaaagagccttgttgtggtggctggtctggaccttgttcaggactggcaattggcttatgttgaagggcttgagaaggctgaacaagaggtgaaactaatttatctggaaagggctacaattgggttctacttgttgcctaacaatgatcacttctacagcgtcatgaacgagataaacaagtttgtcaattctaactgttaatagacttactcttacatatgatacaggcagagagatacataacagaagcttgacatttcactcggggttattttttcctcctctttcgggttgatatcgtgtgcagtgtataagagtgtgtagtactactatgtggttgtgtcgtcgtctattatggtggaatgaggtctgcatctctgcccgactgggttcttcattctagagatgttggtttcagtttcctggttgcagagttgtgctatctttaggggacttggttcaattggttcagttggatcagaattcattcactgatgtatgtaatgtgagaacatatactggctgaacttggggctcacctggttcaatgaagctgttactgaccaccggagctgtttgacaacaggtctttttagcgcaccaaacttaggttaccctgacttctcactgcgaaaaggggaaggcaagaggagtgcggtaacgttgtggtggttattacaatcgatgcattgctaatgttacaagaactaattcagaacatggattaggaaacatccatggtattgtgacttgtatgctatacttgtcttactagaattattacataaagatgtttgcccttttaactg

SEQ ID NO: 287 - DNA, 1482 bp, Eschscholzia californica
ccacaacttctcattctaacaacttatttcaaaatcatcatcaaactcaaatatttcttcaatctttcttctttatcaacaatggaagataaatcttcatcacttatatccaatattaatccatatgaagcactacaacttgtttacgacgcacaagccgattctctcacatgtaatcttcctgttccaactatcgaatcgtcgggcgatccgaattgtaaggatatacctctcaacattgagaaaaagacatgggttcgaatttttagacccacaaccatcaccacccccacaaccaccagtgttaccactgcaacaaccaccacaaataagcttccaatcataatctactttcatggtggtgggttcatcctgtttagtgcagcctcaggtatgttccatgatttctgcaaatccatggctgcccaagtacaagctttagttgtctcagtagagtaccgcctagcacccgaaaagcgtcttccggcagcttatgatgatgcaacagatgccataaattgggttaggaatcaagccatggatcctgttaatggtgagccatggttgagagactatgctgatttctcgaagtgttttctaatgggttgtagtgctggtgctaatatttcataccatgttggtttaaaagcatgtgaattggatttggaaccaataaagatttctgggttgatactgaaccaacccttttttggtggatcaaagaggacagaatcagagattagactgagggatgatcagattttgtctaacccagtgattgatttgatgtggaaattgagtttgccaattggggtagatcaagatcatgtatatagtaatccaatggctaataatggtgggggaaatgttaaagtgataaagaggatatttgtgaatggatgtgatggagatccattatttgatcgtcaagttgagtttgtgaagatgttggaagacaagggtttaaaggttgaagcttccatggaagaaggtgggtttcatgggatgactttccttgatcccaaacaaactgattttttctgcaaaaagttgaaggatttcattttcctctcacaagttgtttaatggagattgcaacaaaaaacaaatgttgtttaatggaaagtggagcaagatcaaagggtatgtgttgattaatgtttttgtttgattaattgtaggaaaatgaattggggactccctaggacatactcccaagtatactccctctcacaagacaagatcattttagttttttcaatctgataaaaattgcgaaaagaccaaaatgacattgtcattgtgagggggagtacgcctgggagtatgcccagagagtccccctatcatcattgattgtcttataccttataaccactatgactaacataaagggtcacgtggaattgggtgaagagtcatgtaaccataaaattcttaatgacgatgttggatttgtccgccaataattagcttacgacg

SEQ ID NO: 288 - DNA, 1170 bp, Glaucium flavum
actccacccacccaaccacaaattcattttaaatctccacatgcaatcatcaagccctcaaataaaaaataccaataagactagaaagaaccccaacccaacaatggcggatcaaccacccaccacaattaatccttatgaagctctcaaaatcgttcacaatccagatgacacactcactcgtaacctccccattccagataccccttcttcagatgatccaaattgcaaagacacctctctcaaccctcaacacaaaacctggatcagaatcttcagacccactaaaacccaatctcaagataatgatttttctataacaaataagcttcctatcatagtttacttccatggtggtggattcatcctctgcagtgcattctccactatcttccatgatttctgcaaaaatatggcaacccaattaccagctttggtactctctgtggagtatcgtctcgcacccgaaagccgtctccccgccgcctacgacgacgcggtcgacgctttaaattgggttcggaaccaagctttagagactgctaatggcgaggaatggttgagggattatgcagatttctcaaactgtttcattatggggtgtagtgcaggtgggaacattgcatatcatactggtacaagagcattagaattggatctggaaccaattaagatttctgggctgatactgaaccagccttattttggtggagtagagaggactggatcggagttaagattgattaatgataaggcgttaccgcttgcaatgaatgatatgatgtgggaattgggattgccaattggggctgatcgagatcatttttattgtaatccgatggttaagattgatggtgagagtgggactagagatgaaggaaagcttgggttgaggatgataaggtgtttgacgattgcgggttatgatgacccgttgtttgaccgacagattgaacttgggaagatgttggaagggaaaggagtgaaggttgtgaggtttattgataaagaaggatatcatggaatggtgcattttgatcagaaaaaagccgaagaaatgtttgtagcagtgaaagattttatttcctctactaattaatgtgaaattggccttgttaaatgttaatggtggagccttgtgtttgaggacattttttttttttttttttt

SEQ ID NO: 289 - DNA, 1391 bp, Hydrastis canadensis
gattcttctagagttgaatgggctgaaaccccccaaatttgtctataaatagatctattgtatcctcacaaaccaattcacccattccattgattgatcagttattctccattctctaattccataaacaaataattttagtccatttttaacatggctgatcaaaattcatccgttgaacccatcgatccttacaaatttcttaatatcatttacaatccctccgatgacacactcactagaaacaaccacttcccatctacccctattacacctgatgtcaaaaacgccaaagacatctctcttaacactactaagaaaacatgggtaagactctttagacccaatgaaccatctcttaatagaaagcttcctattatagtttatagtcacggtggtggtttcattcttcagagtgcttcagatactgtgtttcacaacttttgtgcttctatggcaaatatattacctgccttagttgtttcaattgagtatcgtttagcacctgaaagtagacttccaggagcttatgaagatacaattgaagctataaattgggttaaaaaccaagcattagatatgaatggtgagcaatggttaaaagattttgctgatttttctaattgctatctcatggggagtagtgcaggtggcaacattgtgtaccatgcaggtttacgtgcgttatcattggatcttgaccctttgataatcaaaggattcatattaaattcacctttttttggtgggtccaaaaggactgaatcagaattgagattgataaatgatacgcttcttcctttagctgtgaatgatttgatgtgggagttgtcgttgccgaaagggtgtgatcgcggtcacgagtattgtaatccaatggttgatagtagttataaacaaaacattgggttgattgagaagtgttttgtgagtgtgggtggtgaggaccctttgatggaccgtgagatggaatttgtgaaaatgttgaaggagaaaggtgtgaaggttgtagtttggtttgataaggaaggattgcatgggatggaaattacagttccaggtaaagatcaagctttatttgtgctccttaaaagttttgtttattaagaaatgagaagatctttaggaactttgataccattcttgcgatcaaggcagcttgcctatggttttggtcctcttatgggaatacacatgaggggagaaggtttgatgatattgtagtgtattgagtggtgtgtgtttgtttttttttgtacatatattgagtggtgtgctttaattatttctctttgtttcctttcccatttatttgggatacttgtaataatggttcattgtcttcttcaagattattaatctgttcttcaagataatcaatctcagcccta

SEQ ID NO: 290 - DNA, 1229 bp, Hydrastis canadensis
agaaaattcaacaattttctctttttcttctcctctataaaaccatcaaatcacacaaaccagctcaatccacaatcattcacatcaaaatcaaatggcaaacccaaacccagtcaccatagatccatttaaacaactcattatcactctcaacccagatggtactctcactagacccactttagttccaattgttccaccaacaggtgaaatcaattcccattcaaaaaccccatcagttatttccatggatgtccctctaaatccttcaaaaaacacttggattagagtctttcaaccttctaatctttcttcaaattcaaaacaccctctcataatttactttcatgggggtggttttgttctttatagtgcagcatctaaaccatttcatgaatcttgttgtcaaatggctagtgaattatctgctgtgattctatcaattgaatatcttcttgctcctgaaaataaattaccctcagcttatgaagatgcagaggatgcaatgctttgggtgaagaaacaagctttgaattgtgagtataaattttgtgaatttgtagatttctctaagtgttttattatgggtagtagttctggtggtaatataacttatcaagcaggtttcagagccttgaaattagatctagaaccaattacaatcaatggggttatcatgaatcaaccattctttggtggggttgaaagaactgaatctgagttaagattgattaatgatagaattttgcctttaccaacatgtgatttgatgtgggaatttgctttgcctattggttctaatagagatcatgagtattgtaaccccattgggtcccaccataatgaaatcaaatggttaccaaggtgttatgttagagggtatggtggggacccattgattgatagacagatgaagtttgtgaaaatgttagaagatcatggagcttgtgttgtgaaacattttcttgatgatggttttcatgcttgtgagttatttgatcctaagatggctgaagctttgtatgtagatcttagagatttcatttactcttctgagtcaaatgctgttgtcaagtcaaagtattgagttgaagagatattagaaattaattagtaatttggtttggtatcatatttgattgtgactcgggagatgggatatggtttagtattgtttgtgatgctaataaaatatgagtactttgttatctctttttcaaattttttta

SEQ ID NO: 291 - DNA, 1401 bp, Hydrastis canadensis
aagccttaaacaattcaattgtgtgaattggacaaattgggaattagagatgcgaaaatgtgtagggctgagattgattatcttgaagaacagattaataatcttgaagaagacaatgaaccattattacaagtatcccaaataaatgggaaaggaaacaaagagaaataattaaagcacaccactcaatatatgtacaaaaaaaaacaaacacacaccactcaatacactacaatatcatcaaaccttctcccctcatgtgtattcccataagaggaccaaaaccataggcaagctgccttgatcgcaagaatggtatcaaagttcctaaagatcttctcatttcttaataaacaaaacttttaaggagcacaaataaagcttgatctttacctggaactgtaatttccatcccatgcaatccttccttatcaaaccaaactacaaccttcacacctttctccttcaacattttcacaaattccatctcacggtccatcaaagggtcctcaccacccacactcacaaaacacttctcaatcaacccaatgttttgtttataactactatcaaccattggattacaatactcgtgaccgcgatcacaccctttcggcaacgacaactcccacatcaaatcattcacagctaaaggaagaagcgtatcatttatcaatctcaattctgattcagtccttttggacccaccaaaaaaaggtgaatttaatatgaatcctttgattatcaaagggtcaagatccaatgataacgcacgtaaacctgcatggtacacaatgttgccacctgcactactccccatgagatagcaattagaaaaatcagcaaaatcttttaaccattgctcaccattcatatctaatgcttggtttttaacccaatttatagcttcaattgtatcttcataagctcctggaagtctactttcaggtgctaaacgatactcaattgaaacaactaaggcaggtaatatatttgccatagaagcacaaaagttgtgaaacacagtatctgaagcactctgaagaatgaaaccaccaccgtgactataaactataataggaagctttctattaagagatggttcattgggtctaaagagtcttacccatgttttcttagtagtgttaagagagatgtctttggcgtttttgacatcaggtgtaataggggtagatgggaagtggttgtttctagtgagtgtgtcatcggagggattgtaaatgatattaagaaatttgtaaggatcgatgggttcaacggatgaattttgatcagccatgttaaaaatggactaaaattatttgtttatggaattagagaatggagaataactgatcaatcaatggaatgggtcccgcgaatggggagcccgcaggccga

SEQ ID NO: 292 - DNA, 1475 bp, Jeffersonia Diphylla
catttatcccaacctccaatgtcatccatctctttcattgacaaacataaaattgagcaataaaattgggaaacagtactacttatcatccaaatttaagctaaatacaaaaattaatttactttgcattctcaagagaaagttcactgaaaactgattttgtcagcactaaacacctctctccaaaatcaaccttcaagttatcttacaataccaatcacttgcaaataggccatggttcttgtgcttcttgagtcagaacacactgcaaaaaaacatttttatctcactatatctgcatagttgggacttgggacgccaaaccttcgggacagcaaaaccggactcacaaagagatcatgacacagacaacattgaattggctttctccagattttattataccttgtcactagctttattattcaataggtttatcaacactagcagcagttacaggtgaatagataaaatccttaagatccatcaccaaggcccgacccttgtctggatcaaagaactctacagcatgataagcatcagcatcatcaaagaaatgttccacaacacacaccccatgccctttcaacttctcaaccaactgtttctcacgatctactaacgggtccatttcatagccattgacatagcacgttggcaacctctgaatgtctttttggttggacccttcgaccattggattagaatattcatggtctcgatcagttccaactggtaacgcaagttcccacattaaatcggcaacgggtaatggcaagatgggatcatccacacatttcagttcggattcagttctttcaacgccaccaaaaaatggtatattaagaatcaaacctctgatctcgaccggggaaatattcaagttaagcgcgcgtaagccagcgtgataggctatattgccaccggaactactacccatgataaaacactgtgtaaaatcaacaaaggtggtgaacttgtgctcaccatgcaaggcttgttgtttcagccaaagcacagcatcaacagcatcctcgtaagctgctggtaggcgattttcgggggccagacgataatccacagagagaactaaggcaggtgtttcaccagccaagtgaacacagaaatcatgcaaggttaaagaagctgcgctaaacagcagaaaaccacctccatggaagtaaactatgatagggagctttgtgtcggaaggaagatttagggggtggaagattcggatccatgtgttggtggtggtatttagggggacatcaatggaggcaactgatgaatcgttgtagtcgtaacctgttggtggtgtggtaggtacagaagagtctagtcgagtgatagaaccgtctgggttgagaatgaagttcagagcatcatatggatccatagagaattagaatgataagaagaggatgaaacaggcgatcccttttttcttggtttggcctgttgacttcagagtt

SEQ ID NO: 293 - DNA, 1367 bp, Mahonia aquifolium
aatgccgaggcatccttcgaatcttcagcgatggctcgatcttccgctcacctgatccatgcttcaacatccctgtccacaaggatgagtctgtcctctttaaagactgtcttttcgaacccatccaccatctctaccttcgcctctacagaccttccaccatcaccaccaaggccaaacttccgatcttcttctacattcacggtggtggcttctgtatcggctcacgaacctggccaaatttccataacttctgtttttttctctctacccatctccaggctgtagttatctctcctgactatcgattagcgcctgagaatcggcttccagctgccattgatgacagctttgctgctctcaagtgggtccaagatcaagccctgttagagagctgtgacccatggttgtctgactttgcagattttagtagagttttcatatcgggtgagtcagctggtgggaatatagcgcacaatttggcggttagactaggttctggatcaccggagttggctccggtgagagttcgagggtatgtgcttttggcgcccttttttggtgggactgtgaggacgaagtctgaggcagaggggccgttggatactttcttggacttggagcttattgatagatattggaggctgtccataccagttggagacactgctgaccacccgctggtaaacccattcggaccaattagccctagtctcaaaccgaagacactcgatccaatctttgtaattgttggtggcaaggatttgcttagggatcgatgccaggattatgtaacaaaattaagagaatggggaaaattggtcgaatatgttgaattcgatggaaagcaacatgggttctttactattgatctcagttcagaagaggcaaacaagttgatgcaaattatcaaacagttcattgctgaaaatttcaaataaggatctgaagctgatagctacatttgcgacttgccgctcagtattctctttacggtgttggtgcaacagcagccagtagattggatgttaccaaagtcattgtgatggatatgggttagggtgagtagatcatgtttgggaagttctatttacaattaactgttaggaagagttactgaggacatcgttcgacttctaggagaggtactgtaaataactaaagttgtgcgataagagtgaagaattggcggaataaaggaagagaaaatggaaggaacgaagaaatgtgggaagatgaaagttcaatatctggttttgtaaaaactggtgcaagtataaagagaggaatgtaatctatgtcaacgtacatgtgcttggaaatctgactgtacatgcgttcttcatggttatttgattaatggtgtt

SEQ ID NO: 294 - DNA, 1263 bp, Menispermum canadense
tgagatctccttgaattaaataacttatatctgctcatcatcttcgactcttcataaccatggaaaaccagcagcctccgttgctcaacaccaccgatccttacgaaacactaaagatcgtctacaatgccaacgacgacaccctcactcgcctctatcccatcccctgcaccgccgcaacaggtgatcatcacaacctgcccatcatcaccaaagacatctgtctcaacaccacacacaaaacctggctgagactcttcatacccacagaaccaccaccgagtccaaacagcctccctctcataatttacttccacggcggtggcttcgtcctctgcagcgcagccaacactctcttccacgacttctgcgctcgtatcgccgccgatctcccggccgtcgtcgcctcggtcgagtaccgcctcgcgccggagagacggctgccggcggcgtacgaagacgccgtggaggctgtgaattgggtgcgggagcacgggatcaaggagaagtggacgagggattttgttgacttttcaaagtgttatcttatggggaacagttcaggagggaatatagcgtaccgtgcgggcctgcgatgtggatcgttggatctggaaccggtgaagatcgtggggctggtgttgattcagccgtattttggtggggttgagaggagtgagtcggagatgaggttggcgaatgatgggcattttccgttagtggtgaacgatctgatgtgggagttggctttgcctagaggggctgatcgcgatcacgagtattgcaatccgatggttgctggggctcagtgggagaagattgggaaatgttttgtgagcgtgcgcggtggggacccggtgatggaccgccagattgcgttagcgaggagattggaaggagagggagtgaaggtggagagttggtttgaggaggaaggatatcatgggattgagctgtttgatcctgtgaaggcatcggagttgctgctcaagttgaaacattttatttgccctcctgaagctgctgagtatagagtcgttgaaaagtagtagtcgagttggaggcgtgcgtcggtttctcgtgtgtgtgggttttgtttccaacgcattaccaaatagactcaattttcaaagctcaaattgtttttatttccttaaacttatactaattaatctttgtagcaccatgcacgcttgcacccctgttatgcacatccgagctcacatttctttttttcccatttcttaatgccttaccttcttt

SEQ ID NO: 295 - DNA, 1125 bp, Menispermum canadense
aaaccgtggctactcaagcttcaacttcaagcgccatggatgatccctacaagttcctcaacatcgtccccaacccagacggctcgctcacccgactcacccaaatccccacttcaccaccatctcatcatcctgaagccaccagcaacaaatccattaactcatcacttaatgatcactcagtcatctccatggatttctctctcaatcccgccaccaacacctggctccgtctcttccgacccaacaccactacccctcaacacgtcaagctcccaatcataatctactttcacggcggcggctttgttctcttcagcgctgcatctcaaccctttcacgactcctgcgccgccatggccgccgacctcccggctctcgtcctctccgtcgagtaccgcctcgcgcccgagcaccgtctcccggcggccttccacgacgccgtcgacgcaatcgtgtgggtcaagcaaaaggctcttgaacaacattggctctgtgatttggcagatttctccaagtgctttctcatgggcagcagctccggcggcaacatagcttaccacgccgggctgcgcgcgctgggcctggatctcgggccggttaaggtctccgggctgatcttgaaccagccgttcttcggcggggtcgtgaggacggagtcagagctgaggctggccggcgaccggatcttgccgttgcctgccggagatctgatgtgggaattggctctgccagttggatcggatcgagaccatgagtattgtaacccgattatgaaagatagtaatggcggggacattgagaggctgccgaggtgctttgttaatgggtacggtggggacccgttggtggatagacagaaggaatttgtgaagatgttggagcagtgtggagtgagtgaagtggcgcgctttgttgatgatgggtatcatgctgtggagctgtttgatcagagtaaagctaaggatctggtgatggccatcagggcttttatttacactacctctgcaactactactccaaaatcgactttgtaaaggtggaaagatcgatagataagtaattagttgcttaatttgtatgttaattatagttaaaaaggttttaagagttgtgtggtcttta

SEQ ID NO: 296 - DNA, 993 bp, Menispermum canadense
acttgtaattaagaagagtaaacgaaatccttgatctgtagaaacaattcctgaaccttacttggatcagccatctccgcaccatgaaaccctccatcttcaatcttgaccaccaccttcaccccatgtgcatccaacatcttggctaaccccttgattctatccaccagtgcgtcccctgcaaaccctcttatcagacaccttggtaaacattggatcttctgattaacaccatccaacggattagaatactcgtgatcacgatcacttccaggaggcaatgacaacacccacaacagatcactaacagccattggtaaataaggatttctgcttaatatttcttctgattgagttcgttgaatccctccaaaaaatggctgattcaatatcagccctctaatctggaccggattaatatccacatccagagctcgtaaacctgcttggtaagcaatgttaccacctgcactagtacccataatatgaacgtttgaataatcagctagctctttcatccacggatcacatccattgatttctcttgcttgatcacgaacccacatgatggcctccatggcatcatcataagcagcaggaaggcggtgttctggggcaagacgatactcaacggttatgattaaagcaggggcgaaagcagctgcacggctcaacatatcatgaaatggagctgaaatagcactcaagataacgaagccaccaccatgaaaatcaatgatgataggaagtttcttactgtggtggagagggcggaacaagcgtaggaatgtttggttgctggtgttaaggggaatgtctttggagagtgctggctgtcttcgtgacgataagttggctgattcagaggcaagttcaggcgtgggaggtactcgggggaattcgtagcctctggtgagtgaaccgtcaggattaagagcaattttgaggaactggtatggttcatcgatgaccgagggatctcttagatcggaa

SEQ ID NO: 297 - DNA, 893 bp, Nandina domestica
aatctaatccacaaatatattctaaaattataaaaaccactcatatgtagtcttgttgactcatctaccattcaacaacattcagtcattcaagtgcttctgaacggataaaattcttcaaagccacaagcaattcctcagccttttgtggttcaaacaactccatcccatggtacccttcatcatcaaaccacttcacaaccttcacatcttttttctccaacatcctcacaaactccatctggcggtccatcagtgggtccccacctctcatactcacaaaccatgaacaccctttcatcaactcaatcttctcttgatcatcatcatcatcatggaccattggattcgaatacttatgatcgcggtcaacgccttttggcaaagccaactcccacatcaaatcactcactgctaaaggtatcttctgatcattcaccaatctaagctctgactcagtcctcttggtcccaccaaaaaagggttggttcaatatcaacccttggatcttcaaaggctttatatctaaccctaatgcatgcatacctgcatggtaggccatgttgccccctgaactgcatcccatgagaaaaaacttagaaaaatcaccatattttctcaaccactcttcacctccatgcatatccaaaccttggtttcttacccaattaatggcttctatcacatcatcgtaggcagccggaagcctgctttcgggcgctagacgatactcgacggagagaatcaaggcaggtaagtttgtagccaaagatgtgcaaaaattgtggaaaaatgtattggctacgctgcagagaatgaaaccaccaccacgaaagtaaagtacaagagggagcttaagctcaccactattgctaagtgtttgttgaataggt

SEQ ID NO: 298 - DNA, 1395 bp, Nandina domestica
ggaattcgaattagcttttaaaccgaatttattgcccatatgatgttacttccttggcctattatactgtgaattacaaaaaggacttggcacaaataacattacgtaaagcgacccaaactaatctagttcgaaacattccaaattcctataatccatttcttattgtgcaccaccattgccaaaccagtccaccacttgtgccgcacacattaagcaccacgtaaaacacacagaatccaagcaaattacaagaagttacgatggtggattaacagatcaactgccatgagcaccatcaccagttgtagaagagtaaataaattccttaagatccatgtacaaggcctgagccttctcctgatcaaatagctccacagcatgacaaccatcatcgaagaaatgtgcaatgacagacaccccttgtccctccaacattttcacaaactccttctgacggtctaccaacaggtccccaccatgcccattaacatagcactttggtagcttttggatctgcacaaggtcccacacctgaaccattggactacaatactcgtgatctcgatcagccccaataggcaatgacaactcccacattgaatcagtagctagcagtggcaacaccttatcattttcatatttcatttcggatccagttctttcaaccccaccgaagaagggctgattcatgattaacccattgatcctaactggttcaagatccaagttcaatgcccgcaagccagcctgataggccatgttaccaccggaactactacccattatatagcactttgtaaagtcagcagaatcaatgaacttatgctcaccatgtaaggcttgttgtttgagccaaagcattgcatccaccgcgtcttcataagctgatgggagacgattttcaggggctaaccgatactgaactgatagaattacgacaggtagttcaccagctatctgaatgcaaaattcattcaaaggcaaaatccttgcagtgtccataacaaaaccagatcccggaaagtaaagtatgactgggagttttgtactaacggaaggaagattgagagggtggaagattcggatccatgtgttcttcatagagttcagaggaacatctatggttgcgacgttttggggtggggttgaatcagtgtaacctgttggtggtgcataaggaaatataggaggtcgggtgaacgatccatctgggttaggaatgagattgagaactttgaacggatccatggggactttcacagtttgagaattttcggtttttatacagaagttgtgttaaaaattcaacaactaggtgatccaaaggcagtcttaatgcctatgtttcccacgaagctttaccaagacgaatcttgatgatttatctaaacc

SEQ ID NO: 299 - DNA, 1177 bp, Nigella sativa
aaaaaaataaacatattaaaagaatagaaccattgtcatgcacatgtatattttgtcttcaatcttattacaactgacaatgatatttgacctctcggaacggccatcaacttacactaagagacaacaacatcaagaagaagaataaatgaattctttaaccttctcaattaactcttgacccttggttgcatcaaacagctcacaagcatgaaaaccatcatcactaaaatctttaacaacactaactccacgtccctccaacatctcaacaaactccttctgtctgtcaattagtggatccccatcatgccctcttacgtagcaccttggcaactctttgatctcctcctcttcagaacctccctcagccattggattacaatactgatgatctctatcagctccaacaggcaaacaaaattcccacatcaaatcagcaaccaccaagggaaccaccttatcatttacaaatcttaattcagacccagttctttgaatcccaccaaagaatggttgattcataataagccctttaatcttaactggttcaagatccaagactaaagcctttaaccctacatgataagtaatatttgcaccagaactacttcccatgatgaaacattttgaaagatctataaattcccaaaacttatactcacctttcatagcattattcttgacccaaagaagagcatccacagcatcatcataagcagaggggagcttattttcaggggcaagtctgtaatcaactgataagatgatggctggtaattgagtagccatttgaatacaagatacatgaaatggtcttgaagatggactgtaaagaataaatccacccccatgaaagtaaattatgaggggtagcttttgatttgaagaaagatttggtggttgaaagactctcatccatgttttgtttgaagggttgagaggaatatctaatgagattacagatttggggtcatcagatgtgggaagattgggaacttgagtgggtctagtgagtgaaccatctgggtttaggactatgttgatgactttgtatggatctagagcgactgagtttgggttttcatctgccattgtaaagatgagattctctgagatttagagggtttcttttataaagaagccgtcatttaatctcagagaatctcatctttac

SEQ ID NO: 300 - DNA, 1200 bp, Nigella sativa
cttgagcattcattagctttatttgcaaaagataaatcgaactaaacaagaaaatcaaccaaacacaacacattagatataaacgttatttgtaaaacatgggcattcataaacattatttctaaaacatgggcactcagtcacaaagttgacttgttagtttctggggaggagtagatgaaatccttaaggtcgacatacaaagcttgagccttatcagggaagaacaactcacaagcatgaaaaccatcttctaagaagtacttgataacagaagccccttcttcctctaacatcttaacaaactccttctgacgatcaatcaatggatctccaccataccctctcacaaaacaccttggtaaccttttaatctcttgattttgtgaccccttcattggattacaatactgatgatctctatcagctccaacaggcaaacaaaattcccacatcaaatcagcaaccaccaagggaaccaccttatcatttacaaatcttaattcagacccagttctttgaatcccaccaaagaatggttgattcataataagccctttaatcttaactggttcaagatccaagactaaagcctttaaccctacatgataagtaatatttgcaccagaactacttcccatgatgaaacattttgaaagatctataaattcccaaaacttatactcacctttcatagcattattcttgacccaaagaagagcatccacagcatcatcataagcagaggggagcttattttcaggggcaagtctgtaatcaactgataagatgatggctggtaattgagtagccatttgaatacaagatacatgaaatggtcttgaagatggactgtaaagaataaatccacccccatgaaagtaaattatgaggggtagcttttgatttgaagaaagatttggtggttgaaagactctcatccatgttttgtttgaagggttgagaggaatatctaatgagattacagatttggggtcatcagatgtgggaagattgggaacttgagtgggtctagtgagtgaaccatctgggtttaggactatgttgatgactttgtatggatctagagcgactgagtttgggttttcatctgccattgtaaagatgagattctctgagatttagagggtttcttttataaagaagccgtcatttaatctcagagaatctcatctttac

SEQ ID NO: 301 - DNA, 1200 bp, Nigella sativa
aaaaaaataaacatattaaaagaatagaaccattgtcatgcacatgtatattttgtcttcaatcttattacaactgacaatgatatttgacctctcggaacggccatcaacttacactaagagacaacaacatcaagaagaagaataaatgaattctttaaccttctcaattaactcttgacccttggttgcatcaaacagctcacaagcatgaaaaccatcatcactaaaatctttaacaacactaactccacgtccctccaacatctcaacaaactccttctgtctgtcaattagtggatccccatcatgccctcttacgtagcaccttggcaactctttgatctcctcctcttcagaacctccctcagccattggattacaatactgatgatctctatcagctcccacaggtaaactcaactcccacatcaaatcagtcactggtaaaggcaagatgttatcattagccaatctcaactctgacccgctcctctcaaccttaccaaagaagggttggatcatgattaatccattgatcctaaatggttcaagatttagcttcaaagcttgtaaaccaagttggtaagtgatgttaccaccagagctacttcccataataaaacacttggagaaatcaacataatcaaagaagtcgtacttatactcacccttaaaagcatgattcttgacccaaacaaccgcatccaaagcatcttcataggctgagggaagtctatcctctggagcaagactatatccaactgaaagaaccaaagcaggcaattcactggctatttgaagacagaattcactgtaaggaggagatttggcgctgaaaataaggaaaccacctccatggaagtagatgatgagagggatttttggagtcgtgggatgaatgggtggctggaaaattctaatggaagtgtttctgttgggattgagagggatatctgtgcagacaacagacttggtggtgttcaaggatagtgtactaagagggtgggggtgtctagtaagggatccattggcgttaaggactatgctgagagcttcaaatggattaattgttgagttttggttttgagctgccatgtttagattcttgaaagaggatagtataggctagaatctagattaacatcaaaggagaaccagagttattgtcaactggtcacatggctgggtaggtggttg

SEQ ID NO: 302 - DNA, 1223 bp, Nigella sativa
cttgagcattcattagctttatttgcaaaagataaatcgaactaaacaagaaaatcaaccaaacacaacacattagatataaacgttatttgtaaaacatgggcattcataaacattatttctaaaacatgggcactcagtcacaaagttgacttgttagtttctggggaggagtagatgaaatccttaaggtcgacatacaaagcttgagccttatcagggaagaacaactcacaagcatgaaaaccatcttctaagaagtacttgataacagaagccccttcttcctctaacatcttaacaaactccttctgacgatcaatcaatggatctccaccataccctctcacaaaacaccttggtaaccttttaatctcttgattttgtgaccccttcattggattacaatactgatgatctctatcagctcccacaggtaaactcaactcccacatcaaatcagtcactggtaaaggcaagatgttatcattagccaatctcaactctgacccgctcctctcaaccttaccaaagaagggttggatcatgattaatccattgatcctaaatggttcaagatttagcttcaaagcttgtaaaccaagttggtaagtgatgttaccaccagagctacttcccataataaaacacttggagaaatcaacataatcaaagaagtcgtacttatactcacccttaaaagcatgattcttgacccaaacaaccgcatccaaagcatcttcataggctgagggaagtctatcctctggagcaagactatatccaactgaaagaaccaaagcaggcaattcactggctatttgaagacagaattcactgtaaggaggagatttggcgctgaaaataaggaaaccacctccatggaagtagatgatgagagggatttttggagtcgtgggatgaatgggtggctggaaaattctaatggaagtgtttctgttgggattgagagggatatctgtgcagacaacagacttggtggtgttcaaggatagtgtactaagagggtgggggtgtctagtaagggatccattggcgttaaggactatgctgagagcttcaaatggattaattgttgagttttggttttgagctgccatgtttagattcttgaaagaggatagtataggctagaatctagattaacatcaaaggagaaccagagttattgtcaactggtcacatggctgggtaggtggttg

SEQ ID NO: 303 - DNA, 1472 bp, Nigella sativa
ctttttacttgtaaacagggtatttgctaatttttcaagccattctgtcacaaggaagaaccagagcaagatcctttaatccatggacaccttcaaacaactaagtattacctacaatccagatgatgatactatcgaccgactcgtgaccataccttgtaccaccactaaccatcacaattcccttccaaaccaacaaatcttcacccacgacattcctttgaattcttctcacaaaacatccctcagactctacaaacccattaaccctcccctccatgcaaaacttcctcttgtagttttcatccatggcggtggcttcctcttcgccagtcctttcaacactatctacaacgatttctgcacttccatggcaatttccttgggtgttgttgttctttcagtaggttatcgtcttgccccagaaagtcgcctccctgcagcctatgaagatgctttggaggcgttgacttgggtaagagatcaagctgataacattttgttgaaggacatggttgatttctccaattgttacctaatgggagatagtgctggtggtaatattgtctaccatgctggcctccgcgctttaagtataaatcttgagcctttagtaatcaaaggatacatattcattcaaccctttttcggtgggatgaagaggactgaatcagaagtgaggttagcagacgataagatcttatcatcagttgttagtgatcttctgtgggaattaggattgcccaaagggtcagatcgagatcatgagtattgcaatccaatggttggtgggggttttagtgataagattgaattgcttaccaggtgtttcctggtagcgcttggtggagacttactggtggaccgtcagaaggagtttatgaagatgttggaagaaaagggtgtggaggttgtgagctggtttgaggatgaggggtgtcacggtatgtttctttttgaaccagaaaaggctttgcatttgttcgaggtcatcaaagactttatttaccagcctatgcctactgtttgattgtaatcttctgactaggttttcttcttgctctctatggaaactctaagtctattctaagtctatatgatccctccacatatgagatttcgtgattaagttcagaaagttatttgtctactccggcgtagaaagaacaaatttaacaaggggaagagtagaagctactataaaggtagcaatgggggcgggtcgggttgtgttcgtatcgggtcttaacaggttagcggataattgaccttgtacctatatccaactcatttagttatcatgtatggtatataaaactcgtacctaactcgttaattagcgggtatacccaactatacccgtttaaacccattagtatttagtttcacattttttaattaacatgtaaagacttgtttacctatttaaccgataaaaatgtgtcaaaacttattaactttatgcccatatc

SEQ ID NO: 304 - DNA, 1102 bp, Papaver bracteatum
ccagtatagcatacatttcttgaagtaattgaataaaccaaggtgtacctgcgtttctcttataattttgaagctcctgataaaatgaagtctttgactcttggtaacatgatttcaagttcttcaggctcaaagtaaaccattccatgatacccgccttcttgcataaaagtttcaaccttgacaccttttccttccaacatcttcacaaattcaacttgtctatcaatcaatggatctccatcacacccaataaccaaacatttctttataaacccacatttctttcgtaacgattcgtcgtcttcgttgatcaaaagattacaataaggatgatttctattagacccaatcggcaaagacaattcccacatcaagtcacttaccgggagagacaaaatcttgtcattgattagtctcagttcagaactagtcctttcaattccgcccagaaatggttgattcaatataaccccggaaattttcaaagggctaagatccaattccgatgctcttaaagaaacgttgtaagcaatatttccacctgcactttctcccattatataacaatttgtaaaatcagcgtaatcccttagccacggctcacttggtttacctccggaagcttgatgtttgacccagtttagagcatcaacagcatcatcataagcagccggtaatcgactttccggtgcaagacgatactctactgaaagtactattgccggcaaagcgtttgccttggatttgcagtaatcatgatatatagtccaaaatgtgctgcaaagaatgaacccaccaccatggtaataaattatgaccggaagcttatttgctgtgggtaaatcttgaattgtgggtttgaagatacgaatccaagtattgtgttgagcattgagaagtatgtctttggaatttggatcatctgtcgtgtttgtaatttgaagtgggagatttcttgtcagggtatcaagatcaggatcgtgaacaaccattaaggcttcgtaaggatcgatggtactactagtagtagttgaatgttgatctgccatttttggatgtggattaaggtttaggggatgtgcgcttgggatggttttag

SEQ ID NO: 305 - DNA, 1878 bp, Papaver bracteatum
taaaccttaatccacatccaaaaatggcagatcaacattccatcgatccttacgaagccttaatggttgttcacgatcctgatcttgataccctgacaagaaatctcccacttcaaattacaaacacgacagatgatccaaattccaaagacatacttctcaatgctcaacacaatacttggattcgtatcttcaaacccacaattcaagatttacccacagcaaataagcttccggtcataatttattaccatggtggtgggttcattctttgcagcacattttggactatatatcatgattactgcaaatccaaggcaaacgctttgccggcaatagtactttcagtagagtatcgtcttgcaccggaaagtcgattaccggctgcttatgatgatgctgttgatgctctaaactgggtcaaacatcaagcttccggaggtaaaccaagtgagccgtggctaagggattacgctgattttacaaattgttatataatgggagaaagtgcaggtggaaatattgcttacaacgtttctttaagagcatcggaattggatcttggccctgtgaatattaccggggttatattgaatcaaccatttatgggtggaattgaaagaactagttctgaactcagactaatcaatgacaagattttgtctctcccggtaagtgacttgatgtgggaattgtctttgccgattgggtctaatagaaatcatccttattgtaatcttttgatcaacgaagacgacgaatcgttacgaaagaaatgtgggtttataaagaaatgtttggttattgggtgtgatggagatccattgattgatagacaagttgaatttgtgaagatgttggaaggaaaaggtgtcaaggttgaaacttttatgcaagaaggcgggtatcatggaatggtttactttgagcctgaagaacttgaaatcatgttaccaagagtcaaagacttcattttatcaggagcttcaaaattataagagaaacgcaggtacaccttggtttattcaattacttcaagaaatgtatgctatactggactattctgttgcgcaataagtttgcaaaatttgtccttctctctgtatcattccaatttattgcaaaaatttccaataacttctcttttctagtccattttggatttcttgccaattatgtatcctttccttgaattaggagcgtggatcttcaccttctttagtttccaaccatcagatccagataggggtaagtgccaatttaacagttgttttgtgtttttccattttttgttctttctaccgacagttgtgtatgtatgcacctcccaatatatatgagctcgttcaggcaatcacaaaccacagttcatacctttacccaatcatttatccaacaatggctaaaacaggtttcgcctgggctatcgatactgcaacaaccgatccttacgaaaaactaatgtgcatccacagtcccgaagaagatactcttgtcagaaacctcccaatcccagttacacccttagatcaaaacaccaaagacatttctttaaatcctgaacggaaaactttgattcgaatttttcgaccaccaaccgaactctctgtaacaaataagcttcctgtcataatttattttcatggtggtggtttcattcttttcagtacagcttcaactattgtccacaatttctgccaatccattgctactcatttacctgcagtagtcgtttctgtagactaccgtcttgcgccagatagccgacttccggctgcatatgatgatgctgtggatgccctcaactgggtcaaaaaccaaggtttggacaccttaaatggtgaaccatggttgaaagagtatgctgatttctcgatt

SEQ ID NO: 306 - DNA, 2521 bp, Papaver bracteatum
tgcaattttattgtatgaattccatgaccttctaggaactgccgaacatgatttatagtggcatgggatcatagatatccttgacttacagaaccttggaaaacataacaaggtttataagaaagcctcccgtagaaggagggttgtaccacgattttatcaactggctgcaagagaacattgtcagtcacactcatagttgtttcagtctttctatttctttgtctcgattagagacgatgaaacctaaaaaccatcatgtacaaattccttccatcacttgcaccaaaataacatatacacattacacactggttaatataaatcaatgttcagtcaggacgtggttcaagtgacataccatttgacccttttatgtgccaatcgtgttgcaggcaaatatatgtagcagtttggcgcactttaattcaggttataaaggcgcagagtcctaaaactttggggattccaccacccacccaaatgcaggtgcacgtctcacttcgagagaaattgcaggcccgggcagtgaaattgctgcatataataatccaaactcccatcagtcaaaattaaccctacatcagcatctcttcttcatcttaacagcgtctcttcttcatcttgtagtttcctgagcgtcttctttgcatagagtgtgataaaaactgtaacaccaactgttaagacgaatccaatggcgttgtagataatttgagatgtcgaaagatactggtgcccttgtgtggcatctgccaagcttgcaactaaaatcccactgtagattgaaacaaatatttccggcaccactcctaccagcgacccaagtatatacggacaatatttaacaccagtggcaacagaagcataattgaatatgataaatggaaaaggtgaaattctaagtaaggcgacagctcgaaattgatgaaaccaatctccttcaccagctaatcttatgatggcagctttgtctggccatttagccaaccacacctggattttatgatgaaagagagaaccaataaagaatggaattgacatgccgatgctaaacccagctagaatcagcagaaatccatatccataaccaaaactaatgccagctacccacatagaaggggaagatgggatgcacagggcagggaaaaatgtcatagaagcaaacaatatagccgccagcaccttaggactgaatgttctcatttcccagtccaagattgggacaatctccttattcaaaaggaaaggtccaacccagatgagaaaaacaacagcaacagtagcaataacaatccctaacaaacccatcttgaaccaccaacaccaattaatccctttcctaggtgataatggaggtttcaatatctcttcaacttgattatcagaacttctcagcgtcacataatcttcatctcctcgatccattttcacttttattaacaatggtgctaccacttcatccttaccatcataatatgtcatcactcttacagaaaaaaatcaatcaatttcgattaagatcccaaacccaaacgaactactcggaataatttacaacccagctactgatagtcttactagaaactctcccaatccaatcaccaattcagatgatgatccagacaccaaagacatcgagttaaaccccgaaaacaaaacctggatcagaattttcagaccatctgaatctcaacataaccatgaacaacttcttccactgatagtttactttcatggaggtgggtttatcctatgtaatgcaaattcaacgattttccataacttctgcaaatccatggcgaatcagttatcagcgatagtactctctgtagagtatcgccttgcgccagagaaccgattaccggcggcttacgaggatgcggtggaatctctagtttgggttcaaaaccaagctttggacgccataaatggagaaccatggttgagaaattatggtgatttctccaaatgtttcattatggggtgtagtgcaggaggaaatattgcgtacaattcatgtttaggagcatcagaattggatttagaaccaataaagatttgtgggttaatattgaaccaaccatattttggtggagtagaaagaagtaaatctgaattgagattggttaacgataagtgcttgccttcagttgttaatgatttgatgtgggaattaggattaccagttggggttaacagagatcatgtttattgtaatccatttgttgatgagaatttagaaacaaaattaaggtttataaggagatgtttagttacttgtagtaatgaagatcccttggttgatagggatatccagtttgtgaagatgttggaaggaaaaggtgttaaagttgtgagttggattgaggaatttgggtttcatggaatggcacattctgatccagtgaaagctcaagaattgttaaaagttgttaaagatttcattttctctgaagattgagtttactgtcatgttgtacttctattgctgcttggagtgctataataaaatggtgta

SEQ ID NO: 307 - DNA, 1133 bp, Papaver somniferum
aataaaaatccaacaatggcagatccttatgaattcctaatgtgcattcacaatcctgaagaagataccctaacaagaaattttccgattcctgctactcccttagatcaaaacaccaaagacatttctttaaatcctgataggaaaacctcacttcgaatctttcggccaccaaccaaagaacctcctgtaacaaagaataagctgcttcctatcataatttatttccatggtggaggtttcattcttttcaatgcagattcaactatgaaccatgacttttgtcaatcgattgctacacatatacccgcgctggtcgtttctgtagactaccgtcttgctcctgaaaaccgacttcccgctgcctatgatgatgctgttgatgctttaaactgggtcaaagaccaaggtttaggcaaactaaataatagtgaagtatggttaaaagagtatggtgacttctcaaagtgtttcattatggggtgcagctcaggtgctaatgttgcatatcatgccagtttaagagcaatagaaatggatcttgaaccagctaagattaatggattaatattacactgccctttttttggtagtcttgagagaactgaatcagattcaaaagtgatcaacaatcaggacttgccgcttgccgtaagggatgtcatgtgggaactggcgttgccgcttgggtctactcgtgatcacgtttattgtaatccgaatattgatcatgatggatcatcatctggaaatatggtggggttaatcgagagatgttttgtggtaggattttatggggatccacttattgatcgacaaattcagctggtgaagatgctggaggaaaaaggtgtgaaggttgaaacttggattgaacaaggagggtatcatggggtgctatgctttgaccctatgatacgtgaaacctttttggaaaaactaaaacattttattttaaacgacgaatttatatactaaaatatattattagtattaaacaatgaaattcttattttttctaaaatgagcttttggacgaaacattgtgtacgaactagctgatgtaatttttcgttttaccggatttttcattttttttgctttctttctgctctcttttataagtcgttctt

SEQ ID NO: 308 - DNA, 576 bp, Papaver somniferum
cgctgcctatgatgatgctgttgatgctttaaactgggtcaaagaccaaggtttaggcaaactaaataatagtgaagtatggttaaaagagtatggtgacttctcaaagtgttttattatggggtgcagctcaggtgctaatgttgcattttcatgccagtttaagagcaatatgccagtttaagagcaattagaaatggatcttgaaccagctaagattaatggattaatattacactgccctttttttggtagtcttgagagaactgaatcagattcaaaaagtgatcaacaatcaggacttaaagtgatcaacaatcaggacttgccgcttgccgtaagggatgtcatgtgggaactggcgttgccgcttgggtctactcgtgatcacgtttattgtaatccgaatattgatcatgatggatcatcatctggaaatatggtggggttaatcgagagatgttttgtggtaggattttatggggatccacttattgatcgacaaattcagctggtgaagatgctggaggaaaaaggtgtgaaggttgaaacttggattgaacaaggagggtattt

SEQ ID NO: 309 - DNA, 1230 bp, Sanguinaria canadensis
agatcatcatcaattatctcaactagcagcttctgttaactactccattgatccttacgatcgcctcaagatcgtccacaactcagacgatgactcactcattcgactcgttccgctcccaagttacccttcaacagatgatgatgatcaaaactcatgcaaagacatccttctcaaccctcaacacaaaacatcgatccgaattttccgaccaaccaccacacaatttcaacaatcttcgaagaagtatgatttttctgtgaaaaacaaacttcctcccataatttacttccatggcggtggatttatactcggcagtgcattcaacatagtctttcacgactactgcaaatccatggctacccaattacccgctttggtactctccgttgagtaccgtctcgctccagaaaaccgtctcccagccgcctacgacgatgcaatggacgccgtaaattgggttcgaaaccaggccttggacgccattaatggtgagccatggttgagggattatgctgatttctcaaagtgttttcttatggggtttagcgcaggtggaaacattgcatatcatgctggtctacgagcattggaattggatctggaaccaataaagatttctgggcttatattgaaccaaccttattttggtggatcaaagagaaccagatcagagctaagattgactaacgatccgattttgccatgccctatgagcgatctgatgtgggaattggctttgccacgcggcgctaatcgagaccacatgtattgtaatccgatggttgatgatgtgactcgtagaggaaatcgtaataaggtggggttggtaattaggaggtgtttgatggcggggtgtgatggggatccattgatagaccgtcagattgagtttgtgaagatgttggaaggtaagggagtaaaagttgagacttggatggaagagggaggttcccatgggatggtttttgccgatcccaaaaaagctgaaatcctgtttggaaaactaaaagacttcattttcactgatatcgttactaagggagctgcaaactgaaatcgaaaggtgtttttgttaattaagggcatgttaggtgttttagactatatgatagatagtactacactgtttaactattgtggatgaagattatggtagaattataattagattaggaaagattatgattgattgatttggaagatttttttctattttattaagatttg

SEQ ID NO: 310 - DNA, 1118 bp, Sanguinaria canadensis
attcatacttcaaaaaacaaaattcatattcaaattggaaatcggacccatacataagatgtatgattaatagcgaaagcgaatacattttattatgtttcttttcaagtccactacgcaccacacaaactttactaagctataatttgcattccacaccatttcaaaagatttgattacaatactcatgatttcgattagcccataggacacaaaatcacttgcagaagagtaaacgatcgataggtatcgacgatttagcagccccagtggtagaaacaccaacatcagttgcagaagagtagataaatttcctgacatttgttaccaaagcccgagccatctcaggatcaaacaactccacagcatgagaaccatcatcagcaaaatgtgccacaacacacaccccgttcctctccaacatcttcacaaactccttctgatgatcaaccaatggatctcgtccattcccattaataagacaccttggtaacatacgaatcttgcaataatgagacttctcaaccattggattacaatactcatgatttcgattagccccaattggcaatgcaaattcccacatcaaatcactaacaggtaatggcaagatctcatcattcgcatatcgcaattcagatccagttctttccactccaccaaagaatggctgattcaagatcaacccattgatcttaactggttcaatatccaaatccgccacccgcaaaccagcctgataggctatattaccaccagagctactacccattaaaaaacaccctgtgaactcaacaaagtcaacgaacttatgctcaccaccatttaaggcttgtttcttgagccaattaatcgcgtcaatagcatcttcataagctgatgggagacgactctctggagctaatcgatactcgacagacagaattacagcaggtaattcactagccaaacgcacgcaaaactcatggtaaggtaatgatgcagaactgaagacaatgaaaccgcccccatgaaagtaaattatgataggaagtttagaattgtttgaaggaagattggaagggaggaagattctgatccatgtgttcttgtcggtgtttagagggacatctatggaa

SEQ ID NO: 311 - DNA, 1119 bp, Stylophorum diphyllum
taagctgcataaagatttggatttcagaccaaaaaacagacatacagatttggaattttattgagttacaaatttacaatacatggagtcaatcctaagacccaacccattttatgccctaattgaatcagcttagacatcattttatgccctaatgaaatctttcactaccttaaacatttcttcagcatgtttctgatcagaatgcacctttccatgacatccttcctcttcaatccaactcacaactttcacacctttcctttccaacatcttcccaattaccaaacacctctttatcatcaaccaattaatggtgctagtcccaccattgttctcaaccatcatcggattactataaaaatgatcacgatcagccccaatcggtaaacccaattcccaaaacaaatcactcataacaatagaaatcaccttatcattaatcaatctcaactccgatccagttctctctaccccaccaaaaaaaggctggttcaaaataagcccagtaatcttaattggttccagatccaattctaatgatcttaaacaagcatgatatgcaatgttaccacctgcactctcccccataataaaacagtttgagaaatcaccatactccctcaaccattcctcactattaataacatccaaagcttggtctcgaacccaatttagtgcgtcgacggagtcgtcgtaggcggcgggaagtctgctttcgggtgcgagacggtactctactgagattaccaaagctgatgattggatcgccattgacttgcagaaatcgtggaagatagttgaggatggactgcaaatgatgaacccaccaccatgaaaataaattatgacaggaatcttcttgttttgatcatcttgaaattgggttttggtgggtctgaagattcttatccaagttttgtgttgagggttgagagggatatctttgcagtttggatcatctgatgaaggggtatctgggatggggagattacgggttagtgtgtcatctggattgtgaacgatattgagagcttcataaggattaatggtggtggatgattgatccgccattgttagaggcttatagctaggtgggtttattggtggaagagattc

SEQ ID NO: 312 - DNA, 1251 bp, Tinospora cordifolia
atgctagacagtagcacgagaacagcaaattgtatatgtgtaagcaataataacaaggtctaagtacctcatttttcgtaaataaaatgtttgatttttaccagcaactcggaagccttctcacaatccgatagctcgaccccatgatacccttcttcctcaaaccaacactttaccttccctcccttttcctctatcatcttcacaagttccatctgcctgtccctcaacatgtctccgccacgtacacataccaaaaacctccccaactgtccgatcttctccccataatcaccaaccatcggattacaatactcatgatcacggtcagctgctttcggcaacgacaactcccacatgacgtcagtcatgcccacagtaaaattttcatcgtttcccagtctcatctctgatgcagttctttgtaccccaccgaaatacggctgaatcaatattatccctacgatcttcaacggatccagatctaaatgtaggcttcgcaagctcgcatgatacgcgatgttgcctcccgcactcaaccccatcagataacacgtgggaaagtcaacctgttctctcagccatacgtcctccagatcatgacccttatcatcacctgcaaccagcgcctgttctcgaacccagtggatggcgtcgacggcgtcatcgtaggccgccggaagccggctttcgggggcaagacggtactccacggagagaacgacggcgggtagctcgacggcgacgcgagagcagaagtcgtggaacatagtgttggctgcactcatgaagatgaagccgccgccgtggaagtatattatgagaggtagcttctttgatggcggtgggccggtcggcaggaagagccgcagccaagtgtgatagctggagttaagaggaaggtctttggtgagaacgggttggctggagactgccggagagtggtggtgatcgtcgtcggtgttggttgggttggtgcagggtacggtgaagagacgagtgagggtgtcggtttctgggttgtagatgatcttcaaggatttaaaaaagtcggttgggttgattgatgggacatcatcatgatcttccatgtttcgaagaggaaaagatgctgaagaatcagaaacagagaattctcagacaactccaactcttgaacaatagaattatatgttccagtgccatgacaacgcaacaaacttgacctttagttgctagacatcaatcttttgttgctaaaactttttagca

SEQ ID NO: 313 - DNA, 1251 bp, Tinospora cordifolia
atgctagacagtagcacgagaacagcaaattgtatatgtgtaagcaataataacaaggtctaagtacctcatttttcgtaaataaaatgtttgatttttaccagcaactcggaagccttctcacaatccgatagctcgaccccatgatacccttcttcctcaaaccaacactttaccttccctcccttttcctctatcatcttcacaagttccatctgcctgtccctcaacatgtctccgccacgtacacataccaaaaacctccccaactgtccgatcttctccccataatcaccaaccatcggattacaatactcatgatcacggtcagctcctttcggcaacgcgtactcccacatcgcgtcactcatgtccaacgtaaacattccatcattccccaatctcatctccgacccacttctctgtaccccactaaaaaatggttgaatcaataccatccctacgatcttcaccggctccagatctagcggtaagcatcgcaagctcgcatggtatgcgatgttgcctcctgcacttaaccccatgagataacacgtggaaaagtcaacgtattctctcagccatacgttcttaagatcgtgagccttatcatcacccacaaccagcgcctgctcccgaacccagtagatggcgtcgatggcgtcgtcgtaggccgccggaagccggctttcaggggcaagccggtagtctacagaaatgacgacggccggtagctcgacggcgacgcgagagcagaagtcgtggaacatagtgttggctgcgctcaggaagacgaagccgccgccgtggaagtatattatgagaggtagcttctttgatggcggtgggccggtcggcaggaagagccgcagccaagtgtgatagctggagttaagaggaaggtctttggtgagaacgggttggctggagactgccggagagtggtggtgatcgtcgtcggtgttggttgggttggtgcagggtacggtgaagagacgagtgagggtgtcggtttctgggttgtagatgatcttcaaggatttaaaaaagtcggttgggttgattgatgggacatcatcatgatcttccatgtttcgaagaggaaaagatgctgaagaatcagaaacagagaattctcagacaactccaactcttgaacaatagaattatatgttccagtgccatgacaacgcaacaaacttgacctttagttgctagacatcaatcttttgttgctaaaactttttagca

SEQ ID NO: 314 - DNA, 1357 bp, Tinospora cordifolia
ccgattcaattgctagaatatgacgattagatactccacaatttttaatttacacattcactttcacagactcgaaggaaaaattaatacgtaaataggaaatacatatcctaactatgtattttcttactcactaaatgttgagaatatgaaatcctttaaggctacaagcagtgaatccaatttatgggaattatttaagagttcctcgccatgatgatctccttcaacgattctacccttcacttttacacctttttctttcatcgtcgtcaacaatccaatctgacgatcaattccgggatccttatctccagtagacatcagtatcttccaacccaacattttgatcttgtcgaatagttttgacctatccactaccgctggattagaatactcatgatcacgattagctccagccggcaaagagtacttccacatcacatcagttgcaataagaggcagaatgaggtcgtttgccattcttaactcagattcagttctttcatgcccaccaaaaaagggataatgcaatatcaatccattgatcttcaacggcttaaaactgtcaacatcttccattgccacacgtaaaccgacatggtacgctatgttccctccagcgctgcaacccatgatgaagcaattagaaagattagcatggtctctcaaccaagaatcctccgcgaattttatccagttcaaagcttcgactgcatcatcgtacgctgccggcaggagatgctcgggtccaacacggtagtcaatagagacaacaacagcagatagttgtaaagcgagtttggagcaaaagttataacatgtgggtgtggccgtagtggagataacaaaccctccaccagggtagtatacgatgagagggagtagatcattcgtggagttagactcgagcttatatcgagaaatatatacacgagcccaagtattgtttgattggttgatcgggatatctttggagagaaccggagcggggtagctcagatcaggtacggttggcacagtcggaaaattgctgggtttttttcttgtgattgtgccgtcatggtggtgtacgagatcgacgtagtcgtagggatcggtgattggaacaggggtgaaaggcgctacttgatcggacatgatgagaaatgttcaacagaggtacttgatcatctcttatcttcctacggtgtgtaaattagcatatatggagaggcaagactgcaatttaatttaatgcttggtagggttgggcaattaatttggtgttttcacaagtcgccgtcgatcgagactaattgctactaaaggaagatattttttgtatggctgatagctatctcctccctaacctcct

SEQ ID NO: 315 - DNA, 1690 bp, Thalictrum flavum
atgaacaaaacttaatatgtagacatcttatatatatattatatattatattctaaaacaaagtataagatacaagatcacactaacatggatgtttccccatcctgttttgacactacactactacgacccataacccattacattaaccgtaaaccctatactaaagacttctcagttcatggccaaaagttggagagggtaacctacagaggactgccaacctgttatcaaactgctcttgccgtgagtaacagactcccaaagcggggcttctaagtccagacaactgggctcattacacaaacaacgaaagaatgagttcagctcgaaccgtccaactgaactcattggattaagtctttcctaataagatatacttttctgcatccaggattctaaatacttgctattgctacacgaagaacaatcaccaaggatgcagaccttataacccttagtaccatagacaattaagttaagtaataagtctactacacacccttatggccttgtacactgcacactgctgcctcttaagaacaaaataaacccgtgtgaaatgtcatcaaacttctgttatgtatggctgcttgtatgtaaagtaagtctattgacagttagcaactcaggaagttgtttatctcatccatgaggctgaagaagtgaatgttattcggcaacaagtagaacccaatggtggcttgttccagaaacatcaatttgacatcttgcccagccctctggagtccttggacgtaagccaattgccaatcgtggagtaggtccaaccctgcaactacaacgaggcttttagggaacttaacaccttcaaggcttgcagcattgggaccaaacggattacatgcaggatgtgttctgtctgctccttgagggagaaaagccctccagtaccaatctcggtcttggagggtcacgaagtatttcccatctaatttcttctccgattctgttcgttctaccccaccaaacatgggattaagtagtatattccccagtacctcggtcccggattctactgctctcagtgcaacatgatgggcaatattacccccagaactatctccggcaaggtacacatgagcctttgagtccttcccactccgcagccatggccttgaatgaacccatttaagtgctgcctggccatcatcataagcacatggataccggtattcaggtgcacgtcgataatttacagagaccacaacagctttgctgttgcgcacaagacgacggcatagtgtgtcatagatagcactattagcagaagagtgagcaaagcttcctccatggaagaaaattataactggaacaactacatcactgcttaagggctgttcaagctgaaggaagcttggtcgaccttcagtcgccaaggcctgtcgataaactctgcaaaggagatcagtagccctgtcgatgattacatcgaacgagaaaaccccatcaactgggttcgcattggaaggaactttccgatcaaggaactctgccagatgacgattgaaggtcccatcgggacgacgaagcatggtgtatgccagcttgaaattggagatgagaacccatgtgtttaaaggaaccgccaactaatcacacatcaagaaaatcaataataagtttcaattacaagatcaaaacttcaaattaagaaatttatagtcct

SEQ ID NO: 316 - DNA, 1227 bp, Xanthoriza simplicissima
atttttttcccactactataaatatcactatatacattgaagcaaggtgagaaaataaaaacatttcatagatattcttctaacacagttttcttatccatattccggtaacatggcagaacagaatccatccattttacctataaatccttatgaagtactaggtattgtccacaaccccgacgacacgctaactcgacaaatccaaatcccatgcactactacttctacagatgatatttcctgtgccaaaatcaccaaagacatccctctcaacgcttgtaacaaaacatggctaagattgtttaggccaattgaacaacctgttaacgtaaaacttcctattatactttacttccgtggtggtggtttcatactgtgtagtgcttccaatactatttttcataatttctgtgcttccatggcaaataaatttccagccttaattgtttcagttgattaccgcttagcgcctgaaagccgccttccatcagcctatgaagacgcaattgaagcaatcacttgggttaaaaaacaagccttagatacgaatggtgagcaatggttcaaagacttggctgatttttccaagtgttatcttatgggatgtagctcaggaggcaacattgtgtaccatgtaggtttacgcgctatatctttggatcttaagcctttgttaatcaaaggacttatattgaatcaaccttttttcggagggttgagaaggacagagtctgaaatgaggatggtgaatgacaaaaccttgcctttggttgtgagtgatttgatgtgggaattggctttgccagcaggatctgatcgcgatcatgagtattgtaatccaagggttgatggaggttttaaagaaaatatcaaattgctttcgagatgttttgtgagtgtgcgcggtggagaccctttgatggaccatcagaaggagtttgtgaaaatggtggaggaggaaggtgtgaaggttgtgaactggtttgatgaagcagggtaccatggaatggaactctttgaaccacaaaaagctgaggccatgtttgtggctctcaaagcttttatttattcttctagtgatattgaatagatgtctttgctggtgatagaagctgcaacgttgaatggttttaagttacaaagactcgagtgattttctttaatacaatgatattgaatgtagatcttataggtaagtaacatatttggaaaatcaatgcaaag

SEQ ID NO: 317 - DNA, 1246 bp, Xanthoriza simplicissima
accatcgatataatacgcgctcacaaaaaggctgtataacataatcaccagttcaccactagtattttcattatcttcaacacaacgtcatctctgtatacaatatcaataacatggcaagtcaagcagatcaagcacacgttgatcgatacaaagaacacaacatcatctacaatccagatgacactctcactagactcatcactttcccttgtactagtacaacagatcacaattcccttccaaatcaacctgtttttacccaagacatccctctcaacccaattaataaaacctggatgagactcttcaaacccagtaatccacaacctcctaaaacaaaactccctctaatactttatttccatggtagtggcttcataatcggtagtgcttctaattccacgttccatgacttttgcacttcaatggcaattgaactatcttgtgtcgtcctctcattaggataccgtcttgccccagaaagtcgactcccagctgcttatgaagacgcgatggaagcaatagattgggttcgaaacaaagcactagatttgggcagtgataattgtttgaaggaagtcgttgacttctcaaaatgctatctcatgggcattagttcaggtggaaacatggtgtatcatgcaggtctgcgcgtgttgtcaatggatcttcatcctatgattataaaaggattgatattgaaccatccattttttggcgggttgaaaaggactaattcagaattgagattggctaacgataagttctcattagcttttaccgatataatgtgggagttatcgttgccaaaagtgttcgaccgcgatcatgagtactgcaatccaatggttgaagggagtaacaaggataagattggattgcttggaaggtgttttgtgagtgggtgtggtggggatattttgatagaccgtcagatggagtttgctaagatgttggaggaaaaaggtgcgagtgttgtgacatggtttgaggaagaagggtgccatggagtggagctttttgaaccagagaaaacaagggccttgttttttcttctgaaagaatttatatctggtcagtaatttttgttctctagcatgctacaaaatgagaagcatttgagtgtactgaaaaaataaattgctcctgttttcgtttgtatattcaaataaggattaaccatatcccattctccattggcggagaatttttttttatatttatgaactaatataattttatg

SEQ ID NO: 318 - DNA, 1273 bp, Xanthoriza simplicissima
gattcaattaagtcagcaaaaagcttccacagaatcctcatttccgttcctctttaaaactatcaaaatcacacaataccttctcaatcacactatcatagattcataacaacccaagatctaacaatcatggcagatcaaaatacaattatagatccatacaaacatatcaatgtagttcttaaccctgatggcacacttactagaccaactctagttccaatcatcccaccatcaagtgatcccaattccaactctgttatctccctagacattcctctaaatccctctaaaagcacttggatgagagtttttcaacccccaatctttcttgcaatcaaaaactacctctcatcatttatttccatggtggtggttttgttctttatagtgcatcatctagaccattccatgaatcttgtgttaaaatggctagtgaattaccagctataattatttcagttgattatagtcttgcacctgaaaacaaacttccttctgcttatgaagatggtatggaagcattgctttgggtcaacaaccaggctataaatggtgagtttgagttctgtaaatttgtagatttttccaagtgttttatcatgggaagcagtagtggtgctaatattacttatcaagtgggtttaagagccttaaagttagatcttgaaccagttaagattattgggcttatcatgaaccaaccattttttggtgggattcaaagaactggttctgaattaagaatggtgaatgatagaataattcctctagtagttgctgatttgatgtgggaattagctttgcctattggtgctgataaggatcacgagtattgtaacccaatggcggcccattttaatgagatcaaacagttgccaaggtgttttgtgaatgggtatggtggtgatccgctggttgatcgtcagaaagaatttgccaagatgttaggggagcatggggcttgtcttgtggaacattattctgatgatggttttcatgcttgtgaattgtttatccctgataaggctcaggctttggtgatgaacattagagatttcatttactctcctggtattggctccaacgctgctacgtcaactttgtgagtttttgccttttggggatatgactatgagaacttacctttgcatcttctattgtatgtgcttaataattggtatgacgaaacaaatgatatgctttttggtttttatagggtaggagtttcgggaaaaacttatattatcccctctctcgttttctttttatc

SEQ ID NO: 319 - protein, 349 aa, Argemone mexicana
MAENNSSIITTNVTNPYEYLKIVHNSEDDTLTRLDPVPITNPITNVQNCKDIPLNIQHKTWIRLFKPPQLQQQKSSKKDDEFSKSLSNNQSFPLIIYFHGGGFIMNSAASNYEHVFCEFVTTRIPAFIASVEYRLAPENRLPAAYDDAVEALNWVKNQALDTINGEQWLRNFVDFSKCFIMGCSAGGNIAYHACLRTLELDLEPIKISGFILNQPYFGGLRRTESELRLINNWMLPLVINDLMWELSLPIGANRDHVYCNPMVDIDNSSSTILGLVKKLGLIRMKCLVIGCDGDPLIDRQIEFVKLLKEKGVMVESCIEEGGFHGVGFSCPEKTDELCVKLKDFILGTY

SEQ ID NO: 320 - protein, 326 aa, Berberis thunbergii
VDQSQSQTPINPYNLLGLVHNSDDTLTRLISPTCRYEDDQSIIQDIPLNTAHKTWLRLFKPIESPRITNGDKLPIILYFHGGGFILCSAAQTIFHDFCTSLANKLPAFILSVEYRLAPESRLPAAYNDAVQAINWVRDQALNLNGEPLLREFGDFSKCFLMGCSSGGNIVYHAGLQALDLDIEPLKIRGLVLNQPFFGGTQRTKSELRLVDDKILPLSMSDMMWELALPRRVDRDHKYCNPMIHGDDDKKNGLIKRCFVSVRSGDPLMDHQMEFVRMLERKGVHVVRWFDDNEKEGYHGIELYEPQKAEVLFAALIDFVYSSEATE

SEQ ID NO: 321 - protein, 257 aa, Chelidonium majus
MLPIIIYFHGGGFILFNADSTMNHDFCQSIATHIPALVVSVDYRLAPENRLPAAYDDAVDALNWVKDQGLGKLNNSEVWLKEYGDFSKCFIMGCSSGANVAYHASLRAIEMDLEPAKINGLILHCPFFGSLERTESDSKVINNQDLPLAVRDVMWELALPLGSTRDHVYCNPNIDHDGSSSGNMVGLIERCFVVGFYGDPLIDRQIQLVKMLEEKGVKVETWIEQGGYHGVLCFDPMIRETFLEKLKHFILNDEFIY

SEQ ID NO: 322 - protein, 320 aa, Cissampelos mucronata
MDPYKFLSISPNPDGSLTRHTRIPTSPPTNNPTVASADFPLNPSNNTWFRLYKPTNTPTSAKVPIVIYFHEGGFVLFSAASQPFHDCCAALASQLQALVMSVEYRLAPEHRLPCAYDDAIDAIAWVRGQALGGGNGWFGDSVDFSRCFLMGSSSGGNIVYKAGLMSLEKGLIGGGAEHVKLVGLIMNQPFFGGVERTDSELRYADDRILPLPAGDLLWELALPTGSDRDHEFCNPLKGVSGEIERLPRCFVNGYCRDPLIDRQRQFAKMLERNGVSVVERFVDDGFHACELFDPDKARALALAIKDFIYDCGAGGAKSAL

SEQ ID NO: 323 - protein, 354 aa, Cissampelos mucronata
MRNKRMAALSFDNARLGHQVGQDHRQKPGVLIEEIDGLIRVYKDGHVERPPVVPNVDCIAYIESSLTCRDVIIDKFTNVWARFYVPRTQGTKLPFLVYFHGGGFCVGSAAWSCYHEFLTKVATKAGCVIMSVNYRLSPEHRLPTAYEDGVGALMWVRREILRGSSEQKWWWSHCNFSQVFIVGDSAGANIAHHVTTRVGQLGASSDEPNILSPMTLKGTILIQPFFGGEARTHSEKYMAQPPKSALTVAASDVYWRLSLPLGASRDHRWCNPIAKGAMDLEELRVPPIMVCISELDILKDRNLEFCSAMKRAGKRVEHVVYMGVGHAFQVLNHSQLSQARAHEMMSHIKAFINR

SEQ ID NO: 324 - protein, 344 aa, Cocculus trilobus
MAGSNAVNESQRAVPLNTWILISNFKVAYNLLRRPDGTFNRHLAEFLDRKVPANVIPVEGVFSFDCFIDRATGLLSRIYRPAPADEAEILPGVIDLERPLSTEVVPVIIFFHGGSFAHSSANSAIYDTLCRRLVRNCKAVVVSVNYRRAPENRYPCAYDDGWAALKWVHSRPWLRSGEDSKVHVYLAGDSSGGNIAHHVAMRAVEAGTEVMGNILLNPMFGGMDRTESEKRLDGRYFVTIQDRDWYWRAFLPEGTDRDHPACNPFGPKGADLKGVKFPKSLVVVAGLDLVQDWQLAYVEGLEKAEQEVKLIYLERATIGFYLLPNNDHFYSVMNEINKFVNSNC

SEQ ID NO: 325 - protein, 361 aa, Eschscholzia californica
PQLLILTTYFKIIIKLKYFFNLSSLSTMEDKSSSLISNINPYEALQLVYDAQADSLTCNLPVPTIESSGDPNCKDIPLNIEKKTWVRIFRPTTITTPTTTSVTTATTTTNKLPIIIYFHGGGFILFSAASGMFHDFCKSMAAQVQALVVSVEYRLAPEKRLPAAYDDATDAINWVRNQAMDPVNGEPWLRDYADFSKCFLMGCSAGANISYHVGLKACELDLEPIKISGLILNQPFFGGSKRTESEIRLRDDQILSNPVIDLMWKLSLPIGVDQDHVYSNPMANNGGGNVKVIKRIFVNGCDGDPLFDRQVEFVKMLEDKGLKVEASMEEGGFHGMTFLDPKQTDFFCKKLKDFIFLSQVV

SEQ ID NO: 326 - protein, 352 aa, Glaucium flavum
MQSSSPQIKNTNKTRKNPNPTMADQPPTTINPYEALKIVHNPDDTLTRNLPIPDTPSSDDPNCKDTSLNPQHKTWIRIFRPTKTQSQDNDFSITNKLPIIVYFHGGGFILCSAFSTIFHDFCKNMATQLPALVLSVEYRLAPESRLPAAYDDAVDALNWVRNQALETANGEEWLRDYADFSNCFIMGCSAGGNIAYHTGTRALELDLEPIKISGLILNQPYFGGVERTGSELRLINDKALPLAMNDMMWELGLPIGADRDHFYCNPMVKIDGESGTRDEGKLGLRMIRCLTIAGYDDPLFDRQIELGKMLEGKGVKVVRFIDKEGYHGMVHFDQKKAEEMFVAVKDFISSTN

SEQ ID NO: 327 - protein, 317 aa, Hydrastis canadensis
MADQNSSVEPIDPYKFLNIIYNPSDDTLTRNNHFPSTPITPDVKNAKDISLNTTKKTWVRLFRPNEPSLNRKLPIIVYSHGGGFILQSASDTVFHNFCASMANILPALVVSIEYRLAPESRLPGAYEDTIEAINWVKNQALDMNGEQWLKDFADFSNCYLMGSSAGGNIVYHAGLRALSLDLDPLIIKGFILNSPFFGGSKRTESELRLINDTLLPLAVNDLMWELSLPKGCDRGHEYCNPMVDSSYKQNIGLIEKCFVSVGGEDPLMDREMEFVKMLKEKGVKVVVWFDKEGLHGMEITVPGKDQALFVLLKSFVY

SEQ ID NO: 328 - protein, 330 aa, Hydrastis canadensis
MANPNPVTIDPFKQLIITLNPDGTLTRPTLVPIVPPTGEINSHSKTPSVISMDVPLNPSKNTWIRVFQPSNLSSNSKHPLIIYFHGGGFVLYSAASKPFHESCCQMASELSAVILSIEYLLAPENKLPSAYEDAEDAMLWVKKQALNCEYKFCEFVDFSKCFIMGSSSGGNITYQAGFRALKLDLEPITINGVIMNQPFFGGVERTESELRLINDRILPLPTCDLMWEFALPIGSNRDHEYCNPIGSHHNEIKWLPRCYVRGYGGDPLIDRQMKFVKMLEDHGACVVKHFLDDGFHACELFDPKMAEALYVDLRDFIYSSESNAVVKSKY

SEQ ID NO: 329 - protein, 325 aa, Jeffersonia diphylla
MDPYDALNFILNPDGSITRLDSSVPTTPPTGYDYNDSSVASIDVPLNTTTNTWIRIFHPLNLPSDTKLPIIVYFHGGGFLLFSAASLTLHDFCVHLAGETPALVLSVDYRLAPENRLPAAYEDAVDAVLWLKQQALHGEHKFTTFVDFTQCFIMGSSSGGNIAYHAGLRALNLNISPVEIRGLILNIPFFGGVERTESELKCVDDPILPLPVADLMWELALPVGTDRDHEYSNPMVEGSNQKDIQRLPTCYVNGYEMDPLVDREKQLVEKLKGHGVCVVEHFFDDADAYHAVEFFDPDKGRALVMDLKDFIYSPVTAASVDKPIE

SEQ ID NO: 330 - protein, 329 aa, Menispermum canadense
MENQQPPLLNTTDPYETLKIVYNANDDTLTRLYPIPCTAATGDHHNLPIITKDICLNTTHKTWLRLFIPTEPPPSPNSLPLIIYFHGGGFVLCSAANTLFHDFCARIAADLPAVVASVEYRLAPERRLPAAYEDAVEAVNWVREHGIKEKWTRDFVDFSKCYLMGNSSGGNIAYRAGLRCGSLDLEPVKIVGLVLIQPYFGGVERSESEMRLANDGHFPLVVNDLMWELALPRGADRDHEYCNPMVAGAQWEKIGKCFVSVRGGDPVMDRQIALARRLEGEGVKVESWFEEEGYHGIELFDPVKASELLLKLKHFICPPEAAEYRVVEK

SEQ ID NO: 331 - protein, 333 aa, Menispermum canadense
MDDPYKFLNIVPNPDGSLTRLTQIPTSPPSHHPEATSNKSINSSLNDHSVISMDFSLNPATNTWLRLFRPNTTTPQHVKLPIIIYFHGGGFVLFSAASQPFHDSCAAMAADLPALVLSVEYRLAPEHRLPAAFHDAVDAIVWVKQKALEQHWLCDLADFSKCFLMGSSSGGNIAYHAGLRALGLDLGPVKVSGLILNQPFFGGVVRTESELRLAGDRILPLPAGDLMWELALPVGSDRDHEYCNPIMKDSNGGDIERLPRCFVNGYGGDPLVDRQKEFVKMLEQCGVSEVARFVDDGYHAVELFDQSKAKDLVMAIRAFIYTTSATTTPKSTL

SEQ ID NO: 332 - protein, 327 aa, Menispermum canadense
SDLRDPSVIDEPYQFLKIALNPDGSLTRGYEFPRVPPTPELASESANLSSRRQPALSKDIPLNTSNQTFLRLFRPLHHSKKLPIIIDFHGGGFVILSAISAPFHDMLSRAAAFAPALIITVEYRLAPEHRLPAAYDDAMEAIMWVRDQAREINGCDPWMKELADYSNVHIMGTSAGGNIAYQAGLRALDVDINPVQIRGLILNQPFFGGIQRTQSEEILSRNPYLPMAVSDLLWVLSLPPGSDRDHEYSNPLDGVNQKIQCLPRCLIRGFAGDALVDRIKGLAKMLDAHGVKVVVKIEDGGFHGAEMADPSKVQELFLQIKDFVYSS

SEQ ID NO: 333 - protein, 268 aa, Nandina domestica
PIQQTLSNSGELKLPLVLYFRGGGFILCSVANTFFHNFCTSLATNLPALILSVEYRLAPESRLPAAYDDVIEAINWVRNQGLDMHGGEEWLRKYGDFSKFFLMGCSSGGNMAYHAGMHALGLDIKPLKIQGLILNQPFFGGTKRTESELRLVNDQKIPLAVSDLMWELALPKGVDRDHKYSNPMVHDDDDDQEKIELMKGCSWFVSMRGGDPLMDRQMEFVRMLEKKDVKVVKWFDDEGYHGMELFEPQKAEELLVALKNFIRSEALE

SEQ ID NO: 334 - protein, 323 aa, Nandina Domestica
MDPFKVLNLIPNPDGSFTRPPIFPYAPPTGYTDSTPPQNVATIDVPLNSMKNTWIRIFHPLNLPSVSTKLPVILYFPGSGFVMDTARILPLNEFCIQIAGELPVVILSVQYRLAPENRLPSAYEDAVDAMLWLKQQALHGEHKFIDSADFTKCYIMGSSSGGNMAYQAGLRALNLDLEPVRINGLIMNQPFFGGVERTGSEMKYENDKVLPLLATDSMWELSLPIGADRDHEYCSPMVQVWDLVQIQKLPKCYVNGHGGDLLVDRQKEFVKMLEGQGVSVIAHFFDDGCHAVELFDQEKAQALYMDLKEFIYSSTTGDGAHGS

SEQ ID NO: 335 - protein, 320 aa, Nigella sativa
MADENPNSVALDPYKVINIVLNPDGSLTRPTQVPNLPTSDDPKSVISLDIPLNPSNKTWMRVFQPPNLSSNQKLPLIIYFHGGGFILYSPSSRPFHVSCIQMATQLPAIILSVDYRLAPENKLPSAYDDAVDALLWVKNNAMKGEYKFWEFIDLSKCFIMGSSSGANITYHVGLKALVLDLEPVKIKGLIMNQPFFGGIQRTGSELRFVNDKVVPLVVADLMWEFCLPVGADRDHQYCNPMAEGGSEEEEIKELPRCYVRGHDGDPLIDRQKEFVEMLEGRGVSVVKDFSDDGFHACELFDATKGQELIEKVKEFIYSSS

SEQ ID NO: 336 - protein, 325 aa, Nigella sativa
MADENPNSVALDPYKVINIVLNPDGSLTRPTQVPNLPTSDDPKSVISLDIPLNPSNKTWMRVFQPPNLSSNQKLPLIIYFHGGGFILYSPSSRPFHVSCIQMATQLPAIILSVDYRLAPENKLPSAYDDAVDALLWVKNNAMKGEYKFWEFIDLSKCFIMGSSSGANITYHVGLKALVLDLEPVKIKGLIMNQPFFGGIQRTGSELRFVNDKVVPLVVADLMWEFCLPVGADRDHQYCNPMKGSQNQEIKRLPRCFVRGYGGDPLIDRQKEFVKMLEEEGASVIKYFLEDGFHACELFFPDKAQALYVDLKDFIYSSPETNKSTL

SEQ ID NO: 337 - protein, 321 aa, Nigella sativa
MAAQNQNSTINPFEALSIVLNANGSLTRHPHPLSTLSLNTTKSVVCTDIPLNPNRNTSIRIFQPPIHPTTPKIPLIIYFHGGGFLIFSAKSPPYSEFCLQIASELPALVLSVGYSLAPEDRLPSAYEDALDAVVWVKNHAFKGEYKYDFFDYVDFSKCFIMGSSSGGNITYQLGLQALKLNLEPFRINGLIMIQPFFGKVERSGSELRLANDNILPLPVTDLMWELSLPVGADRDHQYCNPMAEGGSEEEEIKELPRCYVRGHDGDPLIDRQKEFVEMLEGRGVSVVKDFSDDGFHACELFDATKGQELIEKVKEFIYSSS

SEQ ID NO: 338 - protein, 326 aa, Nigella sativa
MAAQNQNSTINPFEALSIVLNANGSLTRHPHPLSTLSLNTTKSVVCTDIPLNPNRNTSIRIFQPPIHPTTPKIPLIIYFHGGGFLIFSAKSPPYSEFCLQIASELPALVLSVGYSLAPEDRLPSAYEDALDAVVWVKNHAFKGEYKYDFFDYVDFSKCFIMGSSSGGNITYQLGLQALKLNLEPFRINGLIMIQPFFGKVERSGSELRLANDNILPLPVTDLMWELSLPVGADRDHQYCNPMKGSQNQEIKRLPRCFVRGYGGDPLIDRQKEFVKMLEEEGASVIKYFLEDGFHACELFFPDKAQALYVDLKDFIYSSPETNKSTL

SEQ ID NO: 339 - protein, 315 aa, Nigella sativa
MDTFKQLSITYNPDDDTIDRLVTIPCTTTNHHNSLPNQQIFTHDIPLNSSHKTSLRLYKPINPPLHAKLPLVVFIHGGGFLFASPFNTIYNDFCTSMAISLGVVVLSVGYRLAPESRLPAAYEDALEALTWVRDQADNILLKDMVDFSNCYLMGDSAGGNIVYHAGLRALSINLEPLVIKGYIFIQPFFGGMKRTESEVRLADDKILSSVVSDLLWELGLPKGSDRDHEYCNPMVGGGFSDKIELLTRCFLVALGGDLLVDRQKEFMKMLEEKGVEVVSWFEDEGCHGMFLFEPEKALHLFEVIKDFIYQPMPTV

SEQ ID NO: 340 - protein, 330 aa, Papaver bracteatum
MADQHSTTTSSTIDPYEALMVVHDPDLDTLTRNLPLQITNTTDDPNSKDILLNAQHNTWIRIFKPTIQDLPTANKLPVIIYYHGGGFILCSTFWTIYHDYCKSKANALPAIVLSVEYRLAPESRLPAAYDDAVDALNWVKHQASGGKPSEPWLRDYADFTNCYIMGESAGGNIAYNVSLRASELDLSPLKISGVILNQPFLGGIERTSSELRLINDKILSLPVSDLMWELSLPIGSNRNHPYCNLLINEDDESLRKKCGFIKKCLVIGCDGDPLIDRQVEFVKMLEGKGVKVETFMQEGGYHGMVYFEPEELEIMLPRVKDFILSGASKL

SEQ ID NO: 341 - protein, 324 aa, Papaver bracteatum
MADQHSIDPYEALMVVHDPDLDTLTRNLPLQITNTTDDPNSKDILLNAQHNTWIRIFKPTIQDLPTANKLPVIIYYHGGGFILCSTFWTIYHDYCKSKANALPAIVLSVEYRLAPESRLPAAYDDAVDALNWVKHQASGGKPSEPWLRDYADFTNCYIMGESAGGNIAYNVSLRASELDLGPVNITGVILNQPFMGGIERTSSELRLINDKILSLPVSDLMWELSLPIGSNRNHPYCNLLINEDDESLRKKCGFIKKCLVIGCDGDPLIDRQVEFVKMLEGKGVKVETFMQEGGYHGMVYFEPEELEIMLPRVKDFILSGASKL

SEQ ID NO: 342 - protein, 247 aa, Papaver bracteatum
MIVYFHGGGFILCNANSTIFHNFCKSMANQLSAIVLSVEYRLAPENRLPAAYEDAVESLVWVQNQALDAINGEPWLRNYGDFSKCFIMGCSAGGNIAYNSCLGASELDLEPIKICGLILNQPYFGGVERSKSELRLVNDKCLPSVVNDLMWELGLPVGVNRDHVYCNPFVDENLETKLRFIRRCLVTCSNEDPLVDRDIQFVKMLEGKGVKVVSWIEEFGFHGMAHSDPVKAQELLKVVKDFIFSED

SEQ ID NO: 343 - protein, 351 aa, Sanguinaria canadensis
DHHQLSQLAASVNYSIDPYDRLKIVHNSDDDSLIRLVPLPSYPSTDDDDQNSCKDILLNPQHKTSIRIFRPTTTQFQQSSKKYDFSVKNKLPPIIYFHGGGFILGSAFNIVFHDYCKSMATQLPALVLSVEYRLAPENRLPAAYDDAMDAVNWVRNQALDAINGEPWLRDYADFSKCFLMGFSAGGNIAYHAGLRALELDLEPIKISGLILNQPYFGGSKRTRSELRLTNDPILPCPMSDLMWELALPRGANRDHMYCNPMVDDVTRRGNRNKVGLVIRRCLMAGCDGDPLIDRQIEFVKMLEGKGVKVETWMEEGGSHGMVFADPKKAEILFGKLKDFIFTDIVTKGAAN

SEQ ID NO: 344 - protein, 299 aa, Sanguinaria canadensis
SIDVPLNTDKNTWIRIFLPSNLPSNNSKLPIIIYFHGGGFIVFSSASLPYHEFCVRLASELPAVILSVEYRLAPESRLPSAYEDAIDAINWLKKQALNGGEHKFVDFVEFTGCFLMGSSSGGNIAYQAGLRVADLDIEPVKINGLILNQPFFGGVERTGSELRYANDEILPLPVSDLMWEFALPIGANRNHEYCNPMVEKSHYCKIRMLPRCLINGNGRDPLVDHQKEFVKMLERNGVCVVAHFADDGSHAVELFDPEMARALVTNVRKFIYSSATDVGVSTTGAAKSSIPIDRLLFCK

SEQ ID NO: 345 - protein, 324 aa, Stylophorum diphyllum
ESLPPINPPSYKPLTMADQSSTTINPYEALNIVHNPDDTLTRNLPIPDTPSSDDPNCKDIPLNPQHKTWIRIFRPTKTQFQDDQNKKIPVIIYFHGGGFIICSPSSTIFHDFCKSMAIQSSALVISVEYRLAPESRLPAAYDDSVDALNWVRDQALDVINSEEWLREYGDFSNCFIMGESAGGNIAYHACLRSLELDLEPIKITGLILNQPFFGGVERTGSELRLINDKVISIVMSDLFWELGLPIGADRDHFYSNPMMVENNGGTSTINWLMIKRCLVIGKMLERKGVKVVSWIEEEGCHGKVHSDQKHAEEMFKVVKDFIRA

SEQ ID NO: 346 - protein, 340 aa, Tinospora cordifolia
MEDHDDVPSINPTDFFKSLKIIYNPETDTLTRLFTVPCTNPTNTDDDHHHSPAVSSQPVLTKDLPLNSSYHTWLRLFLPTGPPPSKKLPLIIYFHGGGFIFMSAANTMFHDFCSRVAVELPAVVLSVEYRLAPESRLPAAYDDAVDAIHWVREQALVAGDDKGHDLEDVWLREQVDFPTCYLMGLSAGGNIAYHASLRSLHLDLDPLKIVGIILIQPYFGGVQRTASEMRLGNDENFTVGMTDVMWELSLPKAADRDHEYCNPMVGDYGEKIGQLGRFLVCVRGGDMLRDRQMELVKMIEEKGGKVKCWFEEEGYHGVELSDCEKASELLVKIKHFIYEK

SEQ ID NO: 347 - protein, 340 aa, Tinospora cordifolia
MEDHDDVPSINPTDFFKSLKIIYNPETDTLTRLFTVPCTNPTNTDDDHHHSPAVSSQPVLTKDLPLNSSYHTWLRLFLPTGPPPSKKLPLIIYFHGGGFVFLSAANTMFHDFCSRVAVELPAVVISVDYRLAPESRLPAAYDDAIDAIYWVREQALVVGDDKAHDLKNVWLREYVDFSTCYLMGLSAGGNIAYHASLRCLPLDLEPVKIVGMVLIQPFFSGVQRSGSEMRLGNDGMFTLDMSDAMWEYALPKGADRDHEYCNPMVGDYGEKIGQLGRFLVCVRGGDMLRDRQMELVKMIEEKGGKVKCWFEEEGYHGVELSDCEKASELLVKIKHFIYEK

SEQ ID NO: 348 - protein, 337 aa, Tinospora cordifolia
MSDQVAPFTPVPITDPYDYVDLVHHHDGTITRKKPSNFPTVPTVPDLSYPAPVLSKDIPINQSNNTWARVYISRYKLESNSTNDLLPLIVYYPGGGFVISTTATPTCYNFCSKLALQLSAVVVSIDYRVGPEHLLPAAYDDAVEALNWIKFAEDSWLRDHANLSNCFIMGCSAGGNIAYHVGLRVAMEDVDSFKPLKINGLILHYPFFGGHERTESELRMANDLILPLIATDVMWKYSLPAGANRDHEYSNPAVVDRSKLFDKIKMLGWKILMSTGDKDPGIDRQIGLLTTMKEKGVKVKGRIVEGDHHGEELLNNSHKLDSLLVALKDFIFSTFSE

SEQ ID NO: 349 - protein, 330 aa, Thalictrum flavum
MAVPLNTWVLISNFKLAYTMLRRPDGTFNRHLAEFLDRKVPSNANPVDGVFSFDVIIDRATDLLCRVYRQALATEGRPSFLQLEQPLSSDVVVPVIIFFHGGSFAHSSANSAIYDTLCRRLVRNSKAVVVSVNYRRAPEYRYPCAYDDGQAALKWVHSRPWLRSGKDSKAHVYLAGDSSGGNIAHHVALRAVESGTEVLGNILLNPMFGGVERTESEKKLDGKYFVTLQDRDWYWRAFLPQGADRTHPACNPFGPNAASLEGVKFPKSLVVVAGLDLLHDWQLAYVQGLQRAGQDVKLMFLEQATIGFYLLPNNIHFFSLMDEINNFLSC

SEQ ID NO: 350 - protein, 326 aa, Xanthoriza simplicissima
MAEQNPSILPINPYEVLGIVHNPDDTLTRQIQIPCTTTSTDDISCAKITKDIPLNACNKTWLRLFRPIEQPVNVKLPIILYFRGGGFILCSASNTIFHNFCASMANKFPALIVSVDYRLAPESRLPSAYEDAIEAITWVKKQALDTNGEQWFKDLADFSKCYLMGCSSGGNIVYHVGLRAISLDLKPLLIKGLILNQPFFGGLRRTESEMRMVNDKTLPLVVSDLMWELALPAGSDRDHEYCNPRVDGGFKENIKLLSRCFVSVRGGDPLMDHQKEFVKMVEEEGVKVVNWFDEAGYHGMELFEPQKAEAMFVALKAFIYSSSDIE

SEQ ID NO: 351 - protein, 323 aa, Xanthoriza simplicissima
MASQADQAHVDRYKEHNIIYNPDDTLTRLITFPCTSTTDHNSLPNQPVFTQDIPLNPINKTWMRLFKPSNPQPPKTKLPLILYFHGSGFIIGSASNSTFHDFCTSMAIELSCVVLSLGYRLAPESRLPAAYEDAMEAIDWVRNKALDLGSDNCLKEVVDFSKCYLMGISSGGNMVYHAGLRVLSMDLHPMIIKGLILNHPFFGGLKRTNSELRLANDKFSLAFTDIMWELSLPKVFDRDHEYCNPMVEGSNKDKIGLLGRCFVSGCGGDILIDRQMEFAKMLEEKGASVVTWFEEEGCHGVELFEPEKTRALFFLLKEFISGQ

SEQ ID NO: 352 - protein, 326 aa, Xanthoriza simplicissima
MADQNTIIDPYKHINVVLNPDGTLTRPTLVPIIPPSSDPNSNSVISLDIPLNPSKSTWMRVFQPPNLSCNQKLPLIIYFHGGGFVLYSASSRPFHESCVKMASELPAIIISVDYSLAPENKLPSAYEDGMEALLWVNNQAINGEFEFCKFVDFSKCFIMGSSSGANITYQVGLRALKLDLEPVKIIGLIMNQPFFGGIQRTGSELRMVNDRIIPLVVADLMWELALPIGADKDHEYCNPMAAHFNEIKQLPRCFVNGYGGDPLVDRQKEFAKMLGEHGACLVEHYSDDGFHACELFIPDKAQALVMNIRDFIYSPGIGSNAATSTL

SEQ ID NO: 353 - DNA, 1008 bp, Argemone mexicana
atggaaggagagaaaggaatagtatgtgttacaggaggagcaggatacttggcatcatggctcatcaagaggctccttcaacatggctacactgttagaacaaccgttcgatctgatccacaattcaaagaagatatcagccacttgaaatccctcccagaagcatcaaagaatctccaagtttacgaagcagacctcgacaaaccaaaaagttttgacgatgttatcaacggttgcataggtgtctttcatgttgctcaccccattgattttgaagggaacaaaatgtctcaagataaagccattaaaatctctatagaaggaacactaggaattttaaaggcatgtttaaaatctaaaacagaaagtaggactgcagtaaagagagttgtttatacttcttctgtagctgcagctgtttttatcagcaacaaaaaagatgttgaagagattaatgagaatatttggacagaagttgaaaccctaaaaaagaatgaatttactagaaatgggtatctaatttcaaagacattaactgaaagatcagcattaaagtttgcagaagaacatgatttggatcttgttactttacttccttccatgattgttggacccttcctcacttctaatctccctttcagtttaacaatctctcaagctttggttctagataacaaagagaattgcaaaatattgaaaaacctgaataatgcagtacatatagatgatgtagcttcggcacaaatataccttttcgaatgcccagaagcaaaagggagacatatttgttcatcagttgatattactatccatgacattgcgaaacttatgtcaattaaatatccggaacttcaattaccaactgatttattaatggaaattgaagaagaaaagcctgtacatatctcttcaaagaaactcttgaacttggggttcaaattcaagtatggttttgaagacatgtatagtgatgcaatacaatgttgtaaagacaagggtttcctttaa

SEQ ID NO: 354 - DNA, 963 bp, Argemone mexicana
atggctgagtactgtgtgacaggagggaccggattcatagcttcttacatagtgaaagcattacttgagaaaggtcacaaggttagggcaacagtgagagacccagataatgtggaaaaggttggatatctttgggagatgcctggagctaaggaaagattaaagctagtaaaagctgatcttatggtcgatgggagcttcgatgatgctgtaaatggtgttgatggtgttttccatacagcatcccctgttcttgtgccttacgacaatgacgttcaggcgacgttgatcgatccaactataaagggcacgcggaatgttttgaaatcatgctctaaagcaagttccgttaagcgagttgtgtatacctcttcttgctctgcagtgagatatcgctacgatgttcaacaagtttcccctctaaatgaatcccattggagtgatcctcagtactgcaaaaaccacaatctatggtatgcgtacgcaaagacattagcagaggaagaagcttggaaaatagccaaggagagcgggattgatctagtggtggtgaacccgtctttcgtagtgggtcccttgattgcaccacaaccaaccagcacacttcttttgatactgggtatcgttaaaggactccgaggagaatatccaaatctcacggtgggatttgtacacatagatgacgtggttgctgcccatatcttagccatggaggagaccaaagcagcaggcaggcttatatgttcgagttccgttgctcacttctcagagatcatcggaatgctcaagtccaagtacccatcatatccatacgaaaacaagtgtggtgaccagaaaggagataataatccgcatagcatgagcagcaacaagattcagcagttgggtctccctcctttaaaaaatctaaatgaaatgtttgaagattgcatcaaaagctttcagaatcagggatttctgtga

SEQ ID NO: 355 - DNA, 987 bp, Berberis thunbergii
atggaaaatggaggagagaaagggagtgtttgtgtaactggtggagctggatacttggcttcatggctcatcatgagactccttgaaaatggttactctgttagagctactgcaagattagacccaaaattcaacgaggatgttactcacctcaaggcctttcctcatgcatcagaaaagctccaaatctttgatgcagatctcaacaaaccggatagtttcaacgatgtcattgaagggtgtgttggggtgttccatgttgctcaccctattgatcttgaagggaagagaccagaggcatcggtaaccaagactgcagttgatggagctctaggaattctcaaggcatgcttgcaagcaaaaactgtcaagaaggtagtttactcttctagtatggccgccgcggtgattagcaagttgaatgtccaggaaattgatgagagccagtggacagacgtcgacttctgtaggacccttgatgttcctggtatttcatatgttatctcaaagacagtgactgaaagagaatccatcaagttcgccaaagagcatggactacaacttgtgacaatgcttcctgcattgattgttggacctttcagctctcctagaattcctgaaagcgttgctatcgccctgtctttgtttaacggtgatccagagaaaccattaccagcatggaacactaatctggtgcacgtagatgatgtggttgcagctcaaattttccttttcgaatctccaaaggcagaggggagatacgtttgttgttcaactaatacaacagttccagagttggccaagtttattacaggcaaatatccagaactaaaagtccgacccgaattactcagcgatgtcggttcagaaaatattgtccgtctctcgtcgaacaagctcttaggcttgggatttgagttcaagcatggtctagagggaatatttgatggggcaatccaatgttgcaaagagaaaaatttactttga

SEQ ID NO: 356 - protein, 981 aa, Berberis thunbergii
ATGGATGTCAAAGGCAAAGTATGTGTGACTGGGGCATCAGGATACATGGCTTCTTGGCTTATTAAACGACTCCTCTTGTCTGGGTATCATGTCTGCGGAACAGTTAGAGAGCCAGGGAATTCTAAGAAAGTAGCTCATCTATGGCAATTGGAAGGAGCTAAGGAACGGCTCCAATTGCTCAAAGCTGATCTAATGGAGGATGGTAGCTTCGATGATGCTGTAATGGGATGTCATGGTGTCTTCCACACCGCCACCCCTGTCTTGACACCCAACATGGTCAAATCTGATCCTAAGGCTAAAATCTTGGCCCCTGCTATTAAGGGTACCTTAAATGTGTTGAGGTCGTGCAAAAAGAATCCGTATCTTAAGCGAGTGGTCTTGACATCATCATCAACAGCCATTAGGGTGAGAGATGAGGTTGACCCCAACATACCCCTGGATGAAATGTCTTGGAGCTCTGTGGAACGCTGCCAAAGGCTCCAGATTTGGTATGCATTATCAAAAGTTCTAGCTGAGAAGGCAGCATGGGAATTTGCAGAAGAGGAGGGGATAGACTTAGTTACTGTTTTACCCTCATTCATAATCGGGCCAAGTTTGCCACTTGATTTGTCCCTCACTGCTTCTGACATCCTTGGTCTTCTTAATGGTGTATCTGAGAGGTTCACGCAGCTTGGAAGAATGGGTTATGTTCACATTGACGATGTAGCACTTTGCCACATCCTTGTGTATGAAGAATCCAGTGCACAAGGAAGATATCTCTGCAGTTCGGTTGTGCTGGATAACAATGACTTGGCGTCCTTTCTAGCTCTCCGCTATCCAAGCTTACCCATACCAAAGAGGTTTGAGCAACTTGATAGACCATCTTTTGATTTCAATACATCCAAGCTGAAGAGCCTGGGCTTCAACTTCAAAGGGATTGAAGAAATGTTTGACGATTGTGTAGCATCACTCAAAGAGCAAGGCCATATTTCTCAGACATGA

SEQ ID NO: 357 - DNA, 963 bp, Berberis thunbergii
atgcctgagttttgtgtaactggaggaactggatttatagcagcttacttggtgaaagcattactagagaaaggctacaatgtcagggcgactgttcgcgacccagaggacgtagaaaaagttaagttcctatgggaaatgaatggagcaaaggaaagactaaagctggtaaaagctgatctcatggtggatgggagctttgatgatgccatacaaggtgtagacggtgtcttccatgctgcatcccccgttcttgtgccccaggatgatcacatccaggaaactttgatcgatccaattataaagggaacaataaatgttctgagctcctgctccaaatcacgcactgttaagcgggttgtactcacttcgtcctgttcttcaataagataccattatgatgtccaaaatgtctcccctcttaatgaaacgcattggagcgatcctgaatactgcaaacattacaatctgtggtatgcatacgcaaagacattgggtgagaaagaggcttggcgactggcagaagagaagggaatcaatctagtagtgatcaatccatcgtttgtggtgggccccttaattgcaccacaaccaaccagcacactcctcatgatactaaggatcataaaaggaaaactaggggagtacccaaacacagcattgggtttcgtacacattgatgatgtggtttccgcccacatgttagcaatggaagaaagtgaagcatcaggcaggtttatatgttcaagcaaagtagctcactggtccgacatcattaagatgctaaaggccaagtatccctcctacccaattgaaaccaagtgtgcgaagaagaaaggagatgacaagctacatagcatggacactagcaagattgaacagttgggactccgtgctttcaaaacactccctcaaatgtttgatgactgcatcaagagcttccaagacaaggaattgctgtga

SEQ ID NO: 358 - DNA, 1002 bp, Chordyalis celanthifolia
atggaaggaggaggagagaaagagaaagggactgtgtgtgtaactggtggtgcagggttcctggcatcatggatcatcatgaggctccttcaacacggttacaccgtgaggaccaccttccggtctgacccagagttcaaagaagatgtcagtcaccttaatgcccttccaggagcatcagagaagctcgaaatctttgaagccgatctcggaaaaccggggagttttaccgaagcaattaatggatgtataggggtttttcatgttgctcatcctaatgattttacagggaaaactacccaagaccaaatggtcaaattatcagttgaaggaactcttggaattctaaaagcatgtttagattcaaagacggtgaaacgagttgtctacacatcctcaatagctgcagcagggttgatgaatgatgccaaagatgtcaaggaaatgaccgaacaaatatggacagaagttgatgcttttagaacccttaatattccagggatttcatatgccgtttcaaagactctaactgaaagagcagctatagaatttgcagaggaaaatgggttggatcttgttaccttacttccatcgatggtcgtaggaccttttatgggttccaatctcccaacgagtgtatccctgggtctatcattagtttttggggatgaagagcttttgaaagctataaaaccatcatgttcttcagtgcacgttgacgatgtagcttccgcagaaatatttctttttgaatgcccggaagcgaaaggaagatacatatgttctgcagctgaaaatacaattcatgacttggtcaaatttcttactgtcaaatatccagaacttcaattgcatactcacttattgaaggagattggagaagcaaaacctggacatgtatcatcgaagaagctaatgagtatgggattcaagttcaagtatgggtttgaggagacgtatgatgaagccataaaatgctgcaaagcaaagggtctcatttag

SEQ ID NO: 359 - DNA, 996 bp, Chordyalis celanthifolia
atgggagtacaaagagaaagagggattgtgtgtgtaactggtggtgcaggtttcttggcatcatggatcatcaagaggctccttgaacgtggttactccgtgaggacaaccatccaatctaatcctgatttcaaggaagacgtcagccacattacttcccttccaggggcatcaaagaagctccaaatatacgaagccgatctcggaaaacctgatagcttttcagaagccattaatggatgcatcggggtctttcatgttgcccatcctactgatttcacaggaaaaactagccaagaagaaatgatcagaatatctgtagaaggaactctaggaattttaaggtcatgtttagattccaaaacagtgaagagagttatctacacatcttccacagttgcagctgggttagggacgagtattgaagatactaaggtaataaatgaacaaatgtggacgaacgttgatgcttttaaaagtacccttaatgctcctggaatttcatacgcggtttcaaagactataacggaaagagcagctatagattttgcacatgaacgtggattggatcttgttacgttacttccttcgatggtcatcggaccttttcttggttcctatcttccgatgagtgtatctttcgctctatctttaatattcggtaatgaagaactcttgaagcatatgaaaccaacatcggtagtagatatagacgatgtagcttccgcgcaaatatttctatttgaatcctcggaagcgaaagggagatacatttgttctgcgggtgaaaaaacaattcatgaggtagctagatttcttcagaagaaatatccagagcttcaaatgcaaactgaaatattgaaggagattgaagaagaagaacctgttcacacatcatcaaagaagctaacgagcttgggattcaatttcaagtatgggtttgaggagatgtatgataacacaataaaatgttgtaaacaaaagggattactttga

SEQ ID NO: 360 - DNA, 999 bp, Chordyalis celanthifolia
atgggagtccaattagagggagggattgtgtgtgtgactggtggtgcagggtttttggcatcatggattatcaagaggctccttgaacaaggttattccgtgaggacaaccatccaatctgaccctgaatttaaggaagatgttagtcacattacttcccttccaggagcattagagaaactcaaaatctttgaagctgatcttggaaagccagatagtttttccgaggccattgatggatgtatcggagtctttcatgttgctcatcctattgatttatcaggaaaaactagccaagaacaaatgatcaaactatctgtcgaaggaactctaggaattcttaagtcatgtttagattccaaaacagtgaaaagagttatatacacatcttccacacttgcggctggattagggacaagtttcgaagatactaaggaaatcaatgaacaaatgtggtcaaacattgatgctttaataaatagcactgataatgctccaggaacttcatatgcgatttcaaagacactaactgaaagagccgctatagattttgcggaggaacatggcttggatcttgttacgatacttccttctatgattgttggaccctttatttgtcccaatctaccgaacagtatagcttacgctctatcttttgttttcggtaacgaagaactcttgaaatatttgacaccaacatcggtagtacatgtagatgatgtagcttctgcacagatatttctactcgaatgttcggaagcgaaagggagatacatttgttctgtgggtgaaaagacaattcatgaggtgactaaatttgttcaaaccaaatatccagagcttaaagtgcaaactcaagtattgaaggagattgaagatgaacaacctgttcacacatcatcaaagaagctaataagcatgggattcaagttcaagtatgggctcgaggaattgtacgatgaaaccattcaatgttgcaaagaaaagggttttctttag

SEQ ID NO: 361 - DNA, 1035 bp, Chordyalis celanthifolia
atgggtgccactgttattgatcaagagaacacagatgatcaagagatggtgatgagaaagggtcctgtggttgtcactggtgctgccggttatataggttcatggcttgtcatgaggcttctccaacatggctacactgttcgtgcaaccgttcgagatcccactaatgttggaaagacgaagcatttagtggagctacctggtgcaaaagaacgactcacgatatggaaagcggacatggacgacgaaggaagctttgatgatgtggtccggggatgcacctgttttttccatctagccacaccaatggacttcgaatcaaatgatcctgagaatgaagtgatcaaacctgcaatcaatggagttttgaatgtgatgagatcatgtaagaaatccacaactctgaaacgtgttgtgttcacaacttctgctggaactgtcaacgttgaagaggttcaaaagccatcatacgatgaaaccaattggagtgacattgatttctgtaggagaacccaaatgactggttggatgtatttcgtatcgaaaacattggctgagaaagcagcatgggattttgctaaagagaacaacatggatttgattacgatcataccaccattagtcgttggtcctttcattatgaatagcatgccacccagcatgatcaccgcgctcgccctgatcaccggaaatgaagctcattattcaatactgaaacagattcagttaattcatttagatgatctgtgcaatgctcatatattcttgtatgagcatcctaaagctgaagggagatatatttgctcttctgcagaccccacaatttatgaacttgccaaaatgttgaaggagaaataccctgagtacaacatccctacaaagtttgagggaatcgatgagtcgatcaagcgtgtccatttctcttcaaagaagcttacagacttgggatttcaattcaagtataccatggaggatatgtttgatggagccattcagacatgcagggagaagaatttactcccacttcaaagctga

SEQ ID NO: 362 - DNA, 1035 bp, Chordyalis celanthifolia; identical to SEQ ID NO: 361

SEQ ID NO: 363 - DNA, 1017 bp, Chordyalis celanthifolia
atgtcaattacccggaaaaaaacggtatgtgttaccggaggtactggctacattgctggggttctcattaagaagttgttagagaagggatatgctgtcaatactactgtcaggaacccagacgatgagaaaaagatttctcctctcttgaagctacaaggtaagtataatgaccttaagattttcaaagcagacctaactattgaagggagtttcgatgaggccattgcctgctgccattttgtcttccatgttgctactcctatacacgtccattcggaagaccccgagaatgacatgatcaagccagcagtccaagggacactcaatgtcttaaactccgtcacgaaagcagagacggtaaagagggtggttttgacatcatcggcgacaacattatcgataaacaaactgaatggggtgggttatgtgatagatgagaaaagctggacggatgttgagttcctgacttctgagaaacctcctaattggggatatgcggccatgaaaacacttgtagagaaggcagcatggaaatttgcagaggaaaacaagatagacctaatcaccatcatccttccactagtgacaggccaatcgttgactcctgaacatgaacctcccagcatgccctttgcaatggcactgctcacagggaacaatgacctgatcaatgtcatgaaagatctgcaaatgctattaggatctgtcgcaatgatacacttggaggacgctgttgaatgtcacatatttctagctgagaatgaatcggcttatggacgttacaattgttgtcccatcaacactggccttgtcgagctaggaaagttttttgaaaatcgatacccgcaatacaatgtccatactgattttggagattttcctgcacaggccaagctgagtatttcatcagagaagcttatcaatgcagggttcaaattccagcatatagggctcgaggaaatttacgatgaatcagtggagtattacattgctttaggattattgcaaaaatga

SEQ ID NO: 364 - DNA, 990 bp, Chelidonium majus
atggaaggagagaaagggacggtttgcgtaacgggtggagctggattccttgcatcatggctcatcatgaggcttcttcaatatggatactctgttcgtaccactattcgatctgatccaaaattcaaggaagatatcagccatctcaaagcccgtccaaaggcacaagagaagctgcaaatctttgaagctgatcttgaaaaaccagaaagctttgacgaggcaattgatgggtgcgtcggggtctttcatgttgcacaccctattgattttgaagggaagatatcccaagacaaaatgatcaaaacttcagtagagggaactataggcattctaaagtcatgcttgaaatataaaacagtgaaaagggttgtctatacatcttctatgggtgcagccatgtttgttagcaacattttagatgtaaaggaggttgatgagaatatgtggacagaagttgataacttcaaaaacattccgcttcctggcgtgccctatgcaatgtcaaagaccataactgaaagagcagctatagaattcgcagaagaacatggcttggatcttgttactttacttcctggtatgattgtcgggcctttcctcggtcccaatctccctatcagtttgtccctcgctctttccatggtgtttggtaatgatgaatacacaaaaataatgagacagacaaatgtagtatacatagacgacatagcttgcgcgcaaatatttcttttggaatgcccaaacgcgaaagggaggcacatttgctctgcacttgatatcacaatccatgatgttgctaaatttatttccttcaaatttccggaacttcaattgcccattagtttattgaaggagattcaagaagaaaagcccattcatgtctcctcagagaagctcttgagtttgggatttaagttcaagtatggttttgaagatatgtatgatggagcaatcaaatgttgcaaagaaaagggttttcttagatga

SEQ ID NO: 365 - DNA, 987 bp, Chelidonium majus
atggaaggtggaagtgatgaaaagaaaggaacagtgtgtgtgacgggtggagctggatacataggctcatggctgatcatgcggctacttgagcgtggctattctgttcgagccaccgttagattggatcctggcctcaacagagatatcagccatcttacaaaccttccaggggcatcagataagctacaaattttcaatgcagatctcaaaaatcctcaaagtttcgatactgcaatagaaggatgtattggcgtctttctcgtagcatacccaggcaacatggatcaaattgaaattgacgatgttgcgaacgaaatgttagaggaagtaaccttagaactactaagagcatgtttgaaatctaagacagtgaaaagagtagtttacacttctagtgcagctgcagttttggtgaatgacaagggtcttatggaaatggatgagagttcatggagtgatgttgaattctgtagaaatgttaaacttcgtggcagttcatatattataacaaagacattaatagagcaagcggctctaaaatttgcagaagaaaatggattggaccttgtgtcgataatacctccgatggtcgttggtcctttcatttgtccacaccttcctgactcggtttctatggctttgtctatcatcttgggtaatcgacatccatatttcgcagtaatgcaaatggtgcatattgatgatatagtctcaggacatatatttctatttgaatgcccgaatgcgaaagggcgatacatctgctcctctatggagacatctgttcatgacatagccaaattttttacaacccattacccagagtttgagctaccaatgaatttgataagtgagatgaaagaagaaaagccaattcacctctctccaaagaagctcttaagtttgggattcaaattcaagtatgatttcaaggatatgtttgatggagcaattcaaagttgcaaagaaaagggtttcttgtag

SEQ ID NO: 366 - DNA, 963 bp, Chelidonium majus
atggcggaatactgtgtaacaggagggactggattcatagcttcttacctagtgaaagctttacttgaaaagggtcacagagttagggcaacagttcgagacccagagaatgtggaaaaggtaggattcctttgggagtttactggagcaaaggaaagactaaagctggtaaaagctgatcttatgatggagggaagctttgacgatgctgtaaatggcgtggatggtgtctttcatacagcatctcctgttaacgtgccttacgacaatgatgttcaggcaactttgatcgatccaagtataaagggaacgatgaatgttctgaaatcttgtgctaaagcaagctctattaagcgagttgtgcttacctcttcctgttctgctgtgagataccgctatgatgttcaacaagtctccccccttaacgaatcgcattggagcgaccctgaatactgcaaaagctacaatctatggtacccatactcaaagacattagccgaagaacatgcatggaaatgggccaaggagagcgggattgatctagtagtggtgaacccatctttcgtcgtgggtcccctgattgcaccatatccaaccagcacactccttatgatattgggaataataaaaggaatgcaaggcgaatatccaaatttcagattgggttttgtacacatagatgacgtagttgctgcccacatcttagccatggaggagagtaaagcatcaggcaggcttatatgttcaagttccgttgctcacttctcagagatcattgaaatgctcaagtccaagtacccatcctacccatttgaaaacaagtgctgtgatcggaaaggagacgacaatccacacagtatggataccagcaagattcgtcagttgggcctccctgcttttaaaactattcctgaaatgttcgaagactgcgtcaaaagcttccaggaaaagggatttctgtga

SEQ ID NO: 367 - DNA, 987 bp, Eschscolzia Californica
atggaaggagaaaaaaaggtggtttgtgtaacaggaggagcaggatacctagcatcatgcctcatcatgaaacttattcaacgtggttactatgttagggccaccatccgatctgacccaaaattcaacgaagatgtaagtcatctaaaagctatcccaggagcacaagagaaactagaaatcttcgacgcagatcttgaagacccagaaagtttcgacaatatcatggagggttgtgtcggagtctttcatgtggctcaaccaattgcatttggtgggagtaaagagattttagaaaaaatcattaaaacgtctctagaaggaactctaggaattctaaaggcatgcttaaaatctaaaacagtgaagaaagttgtatatacttcttcaaaagctgcagccttggatttcaaaaatgaagcaaaggagattgacgaaaatacatggacagacgtcgagacattaagaaagaatgaagttggtgatggttggtacccaatttcgaagacattgagtgaaaatgcagcactagattttgcagaagaacatggtttggatcttgttacgatacttccttcgatgattgttggtggcttccttagttcaactctccctctcgctttgaggctttctctcgctttagtcttgggtactgaagttgaatgtcggctacttgcacaagctggaaacgtggtacacatagaagatgtagtttcagctcatatatttttatttgagcgtccggaagcgaaagggagatacatatgttcatcaaacgatatcaccattcatgacgtcgctaagtttatctcagttaaatatccagaactgaaactaccaaccgaattacttgaggagtttgggaaggaaaaggcaatccattattcctcaaagaagctattggatttggggttcaagttcaagtatgggtttgaagatatgtatactgatgcaattgagtgttgcaaagagaagggttttctctag

SEQ ID NO: 368 - DNA, 996 bp, Glaucium flavum
atggaaggaggaggaggagagaaaggtacggtgtgtgttactggtggagctggattccttgcgtcgtggctcatcaagaggcttcttcagcatggatactctgttcggaccactgttcgatctgatcccaaattcaaggaagatatcacccacctccaagtccttccaggggcacaagagaagcttcaaatctttgaagccgatcttgaaaaaccagatagttttgacaacgccatcgacggatgcgtcggggtatttcatgttgcacacccgattgattttgaagggaagatatcccaagacacaatgatcaaaacctctgtcgagggaactctaggcattctaaagtcatgcttgaaggctaaaacagtgaagagagttgtttacacatcatctatgggtgcagccatgtttattaggaacatcaaagatgttaaggagattgatgagagtatgtggacagaagttgatatctttaaacactttgaaggttatggcatgtcctacgcagtttcgaagaccctaactgaaagagcagctatagaattcgcagaagaacatggcttggatcttgttactatacttcctggtatggttgttgggcctttcgatggtcctaatctcccagtcagtttgtccatggctcttgccttaattcttggtaatgaggagctagctaaactaatgagacaggcaaatgtagtacacatagacgacatagcttctgggcaaatcttccttatggaatgcccagaagcaaaagggagacacatttgttctgcaactgatatcacaatccatggcgttgcaaaacttatttccatcaaattcccagaaattcaattgcctattgatttattaaaggagatcgaggaggaaaagcctattcacgtctcctctgacaagctcttgagtttgggattcaagttcaagcatggttttgaagacatgtatgaaggagcaataagatgttgcaaagaaaagggttttctttag

SEQ ID NO: 369 - DNA, 1065 bp, Glaucium flavum
atgcatatatataagaatgaacccagcagatacacatcttctcaatatgagaagggagagagaaggatggaaggagagaaagggatagtatgtgtaacaggtggagcagggcacctagcatcttggttgatcatgaggctgcttcaacatggatactttgttcggaccaccgttcgatctgaccccaaattcaaagaagatatcagccacctcaaatctcttccagaggcagcagagaagctcgaagtattcgaggctgatctcgagaaaccggaaagtttttccgaagccatcaatggttgtatcggcgtatttcatgtagctcatccaatggaatacgaacaaaaagtgtcccaagagacaattatcaaaatctctgtagaaggaactttgggaattctaaagtcatgcttgaaatctaaaacagtaaaaagagttgtctatacttcttctatagctgcagctataagcatgagtaatgatatcaaggagattaatgagaatgtgtggacagaagtagacattgttaaaaatcttgaaggtccaactgtttcatatgcagtgtcaaagacattaacagaaagagcagctcttgagtttgctgaagaacatggattggatgttgtaaccatactgccttctattattgttggaccttccattagtaacaatcttccagtcagtactgctttggctctttcttctattctagatcaagaagagtacaagacattaaagaaagctcctaagccaccagctgcggtgcacatagatgacatcgtgtcagcagaaatctttcttttcgaatcgcctaaagcgaaaggaagatatatttgttccacagtggatattacagcccgcgatgttgctaaatttatagctacaaaatatccagaacttctattatcaacagatttatcaaaggaattcaaagaagaagaagaagaaaagcctgtccacatctcctcagacaagctgttgagtataggattcaagttcaagtatggttttgaagacatgtatgatgatgcaatacagtattgcaaagagaagggtttcctttag

SEQ ID NO: 370 - DNA, 987 bp, Glaucium flavum
atggaaggcggaagagatgacgagaaaggaattgtgtgtgtgacgggtggaacgggatacatagggtcatggctcatcatgcggctccttgagcgtggttacactgttcgagccaccgttagattggatcctggacacaatagagacatcagccaccttacatcccttcccggtgcattagaaaagcttcaaatcttcaacgcagatctccaaaatcctcaaagtttcaatgctgcaattgatggatgtgtcggcgtttttcttgttgcatatcctatcaacttggatcaaatcgaagttgacgatgctgcaaacggtaaaattgtgttggggactcttgaactactgaaggcatgtttgaaatcaaagacagttaagagagtggtttacacttctagcgcagctacacttatggtaaacgacaagggtcttatggaattggatgagagttcatggagtgatgttgagttctgcagaactgttaaggcttatgggagttcatatatcataccaaagactttaatagaacaagcagctctcaaattttctgaagagaatggattggatcttgtgtcgataattccgccaatggttgttggccctttcatctgctctcacctccctggctcaatttctatggctatggctctcattttagggaaccgatatccacgtgtgccaataacacaaatggtgcacattgacgatatagtttcaggacatatatttctatttgaatgccctgaagcaaaagggcgatacatatgctcttccctggagacatcaattcatgacgttgccaaattctttaccatccattacccagaatttgaaatgccaatgaatttgctaagtgagatgaaagaacaaaagccatttcacctttctccaaagaagctcttaagtttgggattcaaattcaagtatggtctcaaagacatgtttgatggagcaattcaaagttgcagagaaaagggttacttgtga

SEQ ID NO: 371 - DNA, 1137 bp, Glaucium flavum
atgggttctttgagtacaactagtgaagatcagaagatgatgagcaagggtccagttgtagtgaccggagccgccggttattgcggttcgtggctagtaatgaggcttcttcaacaaggttatactgtccgtgcaacagttcgagatcccactaaaatcgaaaagacgaggcatttgttggatctaccaggggcggaggaacgattaaccatatggaaggcagacctcgaggacgaaggaagctttgatgaagtgatagacggatccatctatgtcttccatctagccactccaatggattttgaatcaatagatcctgagaacgaagtgattaagcccacaatccatggagttttaaatgtgatgaagtcctgcaagaaagcgaagaccgtcaagcgtgttgtctttacaacttctgctggaaccgtaaacgttgaagagcaccaaaagccagtttacgacgaaacctcatggagtgacattgagttctgtaggcgggttaagatgactggttggatgtattttgtatcaaaatcattggccgagcaagctgcgtgggactttgcaaagaagaacaacattgatctcattagtgtcataccaacactagttgttggtcccttcattatgaatagcatgcccccaagcatgctcacagcgctcgccctcgtcacaggaaatacggcacattattcaattctaaagcagatccaattggttcacctagacgacctgtgcaatgcccatattttcctagcggaacatccaaatgctaagggaagatacatatgctcttctgaagacccaaccatctttcaactagccaacatgctcaaggacagatatccagaatttgacatccctaccaagtttgaaggtatcgacgagtcaatcaaaccagtccatttctcttcaaagaaacttaaagatctgggcttccaattccagtacaccatggaggacatgtatgacggagcgattcagtcgtgcagggagaagaaattgttcccacctggattagaaaaggataggcagaatgaaaagaaggaagttacaagcaaagttgtcaaggaggagaatgagaagatcacatcagttcatgcagtatctcatgcaaaaccagccattatggcataa

SEQ ID NO: 372 - DNA, 993 bp, Hydrastis canadensis
atggaagaagagaaaggaatagtgtgtgttacgggtggagcaggatgtgtagcttcatggctcatcatgaggctccttcaacatggatactccgttcgagccaccgttcgatctgatccaatgttcaaggaagatacaagccacctccttaacctccctgaggcaccagaaaagctacaaatctttgatgcagatcttgaaaatccagaaagctttgaagcagctatcaatggatgtattggtgtctttcatctctctcatcctatggattttgaaggaaagatacctctagacactctaatcaaaacatctatagagggaactctaggcattttaaaagcatgcttgaaatccaaaacagtgaagagagtagtttacacttcatctatttctgcagcaatgtgcatcagtaacatgaatgaaacggggcaaattgatgagagtatgtggagtgatcttgacatggttagaagccataattttcctgcagtttcttatatagtttcaaagacattgactgaaagtgcagttttagagttttcgaaagaacatggattggatgtagtaacaattcttccttcagcaattgctggtccatttctcacttcttaccttccagttgctttctcccagtctctgcctttgatttttggcaaagaagtgcaactcataaacatgacaaatacaaatctagtgcacatagatgatgtagcctcggcacaaatattcctttttgaatgcccaatagcagaagggagacacatttgttctacaattgatctttcaattcatgggttggcaaaactactttctaacaaatatccagaacttgaacttcaaattccaaccgatgatttaagcaagatggaagaaacaaaacctcttcacctctcatcaaagaagctcttaaatttgggattcaagttcaaatatgatctggaggagatgtttgatggaactattcagtgttgcaaagagaagggttttctttag

SEQ ID NO: 373 - DNA, 1062 bp, Hydrastis canadensis
atggtagcagagggtgactctgtttgtgtcaccggagcagcgggtttcattgggtcatggctggtcatgcggcttctcgaacgaggttacatggttaaggccaccgtgcgtgatcctgacaacataaagaaggtgaagcatctgctagacttaccaaatgctaaaacaagcttgaccctatggaaagctgatcttgtagacgagggaagcttcgacgacgcgataaaagggtgcaccggagtatttcatgtggctactccaatggattttgagtccaaggaccctgagaatgaagttataaagccaacaatagaagggatgttaaatgtgatgaggtcttgtgttaaggctaaaacagttagaagacttgttttcacttcatctgcaggaactgttaacgttcatcaacatccacaacagccaaagtatgatgaaaattgctggactgatgtagaattttgcaggaataagaagatgactggatggatgtatttcgtctccaaaactttggctgaaaaggcagcttgggaatttgccaaagacaacaatttagatttcatcagcattataccgacactcgtcgttgggccctttctcatgtcatcaatgcctcctagtcttataactgctctttcaccaattactggaaatgaagctcattactcaattttaaaacaaattcagttggtccatctagatgatctttccaatgctcatatttatttgtttgagcatccagaagcaaatggcagatatatatgctcttcttatgattccaccatcattgatgttgccaatgtgcttagacagaaattcccagagtataatgtccctaacaagtttaaggatgttgatgaaaatttgaaggcagtggcattctcatcgaaaaggctcatagacttgggattcaagtataagtacagcaaggaggacatgtttgtagaggccattgtttcatgtagagaaaaggggttacttcccctttgcagtgaaacacaagttaatgacaagagcatggaatgtgagaaacgagaagcgagaagcgaaggcggttcagattga

SEQ ID NO: 374 - DNA, 954 bp, Hydrastis canadensis
atggaaagagtgtgtgtaactggagctggaggatttcaggcgtcttggctcgtaaacttgctcctatctaaaggttacatggtccatggaacagtcagaaacccagacgacgaaaagaatgctcatttgaaggaactagaaaaagcctcagaaaacttaaagctcttcaaagctgacttgttggattacgacagtctatttgctgccattaatggatgcagtggtgtcttccatgttgcaagtccagttccttcaggcgctgtacccaatcccgaggtagaattgattgagcctgccgtaacaggtacatctaatgtactaaaggcgtgttccatggcaaagataaagaaagttgtgtatgtatcatctattgctgctgttatgctcaatccaaattggccaaaggataaactcatggatgaatcatgctggtcagacaaggaattctgcaagacaactgagaactggtattgcctatccaaaacagaagcagaaagtcaagccttagattatgcaaagaaaagtggactcgaggtcgtaacagtttgtgcatccatcatcattggaccaatgttgcaatctaaaatgaatgctagtagtttgcttcttctcaggatgttgaaagatgggttggagacactagataacaaaattcggatgtttgtcgatgtgcgtcatgtggctgaagcactattgttggtttacaagaagcctgaagctgaagggagatatatatgttccgcattcacacttacaatgaaggacttgaacgaaaaattgaagactatgtatcctaactataattatcctaaacaaattgttggggttgatgaagcttgggatatcagttcagaaaaattactgaatctgggatggaagtatagaccattggaagatacccttattgactcaataaaaaattatcaagaaaaagggctcttacataaggtatag

SEQ ID NO: 375 - DNA, 981 bp, Jeffersonia diphylla
atggaagggaagacaggaactatgtgtgtgacaggaggagctgggtacctgggttcatggttggttatgaagcttcttaagcgtggttattctgttagagcaacagtcagattagatcctgagcacaagaaggacctcagccatctcaaaaacctcccaggagcgtcagaacaccttaaattttttaatgcggacctcaacaaaccagatagcttcgatgctgccatcgaaggatgtgatggtgtctttcatgtagctcatcccttagatttccaaggaaacgaagcagatcctgctaggatcagtatggcagtagaaggaactcttgggatacttaaggcatgtgtaaactctaagacagtgaagagagtcgtgtacacttctagcgtggctgctgttgttttaaatacaactgggctgatggaaatggatgagaactcatggacagaccttgaacttgttgaaactattaaagctcctggaagctcatatattgtaccgaagacattagcagaacaagctgctataaaatttgcacaagaacatggattggatctgatcacggtggctccttctttgattgttggtccgttcatttgtcctcattttcccacttctgtgttcctggccttagccgtacttatgggtaagaccgataagtttcaatacattagcataaccagtatggtgcacatagaagatatagtggcagcgcatatattccttctcgaatgcccgaatgctaagggacgttttatatgttcagcgcttgatacgacaatccatgacttggctaagtttctgtctagcaagtacgaagattttgaaatgccaatagattcactgaaggagatagaagaaaggaagccacttcatctctcttcaaagaaactgctagacttaggattcacatacaagtatggccttgatgaaatatacgatggagcgattcaatgttgcaaagagaaggggttaatgtag

SEQ ID NO: 376 - DNA, 1002 bp, Jeffersonia diphylla
atgccaaagaaggcggcggtcgatcagaagatggacttcaaaggcaaagtatgtgtgacaggggcctcagggtatctggcttcttggttggttaaacgactcctcctgtctgggtatcatgtgaaaggaacagttagagacccaggaaatagcaaaaaattggcgcatctttggcaactggatggagcaaaggagagacttgaattggtgaaagctgatctgatggaggatggcagctttgatgatgccataatgggctgttgtggtgtcttccacactgcatctcctgtcttgggccctgagtctgatccaaaggctgaaatcctggatcctgctgttaatggaaccctaaacattctgaggtcgtgcaaacggaatccaggtcttaagcgtgtcatactcacgtcttcctctgcagctgttagggtcagagatgattttgacccaaacattccattggatgaaacgtcttggagctcagtggaaatctgtgaaagattccagatttggtatgcattatcgaaaattctagcggagaaggcagcatgggaatttgctaaagaaaatgggattgacttagtcactatcctgccatcattcttaattgggccaagtctgccacatgatttgtgttccactgcatcggatgtccttggtttacttacaggtggtccgaataagttctcctttcacggtaggatgggctacattcacattgatgatgtggcactctgtcacatccttcttttcgaggaagccaaagctcatggaagatacctctgcagttcctttgtgatggataacaatgatctggcatcttttctagctcagcgctatccatacttaccaataactaagaggtttgagccacttgatagaccatgctatgaattcaatacatccaagatgaagagcttgggcttcaaatttaaagggattgaagaaatgttcgacgattgtgtagcatcactcaaggagcaaggctatatactccagaaataa

SEQ ID NO: 377 - DNA, 984 bp, Jeffersonia diphylla
atgagtatcggagcagggaaggtggtatgcgtaactggggcatctgggtacatcgcttcatggctagtgaagcttcttctggaacggggttacactgtcaaagcctctgttcgtgatcccaatgattacaacaagactgtacatttgcgtgcactctctagagccaatgaaaggcttcaattatttaaagcaaatttactggaagaaggatcctttcattctgtaattgatgggtgtgaaggtgtttttcatacagcatctccattttttcataacgtcacagatccacaggctgaattaattgatcctgcagtgaacggaactcttaatgttcttggttcgtgtgcaaaaattccaacagtcaaaagagtggttgtaacatcatcagcagctgcagttgtttataatggaaaaccacggacccctgaagtggtagttgatgagacttggttctcggatgcagaattatgcaagaatctcaagctttggtacgtagtttcaaagaccttagctgaagagtctgcttggaaatttgcagaaaaaaatgggattgatatggttgcaataaatccagcaatggtgattggtccactattacagccgacacttaatacaagtgctgaagctattctgaacataataaaaggaggggaaacttttcccaatcgcactcttggatgggtccatgttaaagatgttgccaacgcacatattctggcctttgagaattcctcggctactggacgatattgtttattcgagagtgttgctcactattctgagctagttaggattctacgtgagctttatcctggtctgaagctccctgagaaaagtgaagatgacaagccatttgcaccgacatatcaagtatccagggagaaagctaaagggctgggcattgatttcattcctttggagattggcctcaaggaaactgttgaaagcttgaaagagaagaagtttgtcagttttgaagtttag

SEQ ID NO: 378 - DNA, 978 bp, Menispermum canadense
atgagcagtggagcaaagaaggtggtgtgcgtgacgggagggtctggctacatagcttcctggcttgtgaagcttctgcttgagcgaggatacactgtcaaggcttctgtgcgggatccaaatgatccaaagaagattggacatttacttgctcttcctggggctaatgaaaggcttaaattgttgaaagcagatttattggaagaaggatcttttgattctgtgattgatgggtgtgaaggtgtctttcatacagcatctccatttttccacgcagtcacagatccacagactgaactaattgcccctgctgtgaaagggactctcaatgttcttagttcttgcgcaaaaactccatctgttaaaagagtagtcgtgacgtcctccatggcagctgttctctactatgggaaacctcgaactccagaggtggttgttgatgagacttggtattctgatccagagttttgcaaggaatcaaagctctggtatgtagtgtcaaagactttagctgaagaagctgcatggaaatttgcaaaagaaaatggacttgatatagtcacaataaatccagcaatggtgattggttcgctgctacaaccaactttaaatacaagtgcggcagctgttctgaatttaataaacggatcagaaacatttccaaattatacttttgcatgggttcatgtgaaagatgtcgccactgcccatattctggcatttgagactccttcagcgagtggaagatattgcttagttgagagggttgctcattattcagatgtcgtgaaggttttgcatgacctctatcctaacctgtcacttcctcagaagtgtgcagatgacaaaccatttgtaccgacttaccaagtctcgattgagaaagccaaaggcttgggcattgatttcattccaatggaggtgagcctcaaggagacggtcgaaggcttgaaggagaaaaacatgatcagtttctga

SEQ ID NO: 379 - DNA, 966 bp, Menispermum canadense
atggagggagcgaacgaaagagtgtgtgtgacaggtgctggtgggtttgtggcatcctggctggtgaagcttctcctctctaagggctacaccgtacatggaactgttagagacccaagagataaaaaaaatgctcacttgatgaagcttaaggaaggctatgagaagctgcagctcttccaggcagacttgatgaattacagttctctttgtgcagccatcacaggttgcaatggagttttccatgttgcaactccagttccaccaggctctgacgcagttcttgaggctgaattggttgagccagctattgtgggtacactaaatgtacttaaagcatgctctgaagcaaaagttaagagagttgtggttgtgtcatcttcggctgctgttgaaatgaatcctaattggccaaaagatcaagttatggatgagacatgttggtccgacaaggaatattgcaaacaaaccaagaactggtattttttctccaaaacagtagcagagaacgaagccttagagtattcaaagggaactgggttggatgttgtgacagtttgtcccagcattgttattgggcctatgctgcaatccactgtaaatggtagtagcttggttctcatcaagattttgaaagatggaattgatagagtagaaaacaaagtgcgtatgcttgtggacgtacgtgaagttgctgaagcactgcttctgacatataagaagcccgaagcccaaggcagatacctatgtgtgtcatacatgatcagaatgaaggatttggtggaaaagctaaggagcgtgtatcctaattataattatccaaagaattttaccgaggttgaggaggaagacaagctgagttctgcaaaactgcagagtctgggatggaaatttaggccactggaggagacacttgctgattctgttaagagctaccaagaggctggtattctagacaaggattag

SEQ ID NO: 380 - DNA, 990 bp, Nandina domestica
atggaaggaggtgataagggtacagtgtgtgttacaggtggagctggattccttgcttcatggctcattacgaggctccttcgacatggttactctgttcgagctactgttcgatctgatccaaaattcaaggaggataccacccacctcatgaacctccccgaggcacaagaaaaacttgcaatcttcgatgcagatctcgagaagcctggaacttttgaacctgtcgttgagggatgtattggtgtttttcatgttgctcatcccatggacatggaagggaaaacaccccaagaaacaataaccaaaatctctgtagagggaactctaggacttctgaatgcatgcttgaaatctaaaacggtgaaaagagttgtatacacttcatctacagctgcagctatgtgtgttagtaatttgaaggaacttcaggaaatagatgagaacatgtggtcagatgttgagatgctcaagggtttgagccttcctggactttcttactctatttcaaagacactcacagaaagagcagcaattgagtttggggcaaagaatggattggatgttgttacattgcttcctgctgcaattgtgggaccattccacactcctaatatccccattggtgttgctctggctttggctttggtatttggtaacgaattagcgtgtcaactcgcaaaacaattaaacattgtccacatagacgatgtagcctctgcgcaaatcttccttttggaatgcccaaaagcagtaggcagacatatttgttcatcagctgatactacaattcatggattagccaaatttttctctgccagataccctgaattccaaatgccaattgatttgttaagcaaaatggaagaagaaaagcctattcacctttcctcaaagaagctcttggatttggggttcaaattcaacaatggtatagagaagatgtatgatggagcaattgagagttgcaaacagaaaggttttctttag

SEQ ID NO: 381 - DNA, 999 bp, Nandina domestica
atggaaatggaaggagagaaagggagtggtagtagagttgtatgtgtaacaggtggaggaggatatatagcatcatggctcatcatgagactccttcaacttggttactctgttcgagccactgccagattggacccaaaattgaagaaagacctcagccacctcacaaacctcccaagagcatcacaaaacctcaagatcttcaacgcggacctaaaccaaccagacagcttcactgctgccatcgaaggttgtgatggacttttccacgtagcgcacccccttgatttggaagactgtgaagttgacgatgcaaaggtgaatatgttagttgaaggaactctaggggttctcaaggcgtgtgtgaagtctaaaacagtgaagcgagttgtctacacttctagtgtggctactgttgttgctaacaaaactgggctcatggagatggatgaaagcatatggagtgacattgattttgttaaagcttataagtttcctggaagctcatatgttgcggctaagacattatcggaacaagcagcgattaagtttgctgaagaacatggtttggaacttgtgacagtgatttcttcgatggtcgccggtccattcatttgtccttcattgcccagctcagtgtgcatggctttggcattgatcatgggtaagagtgatcaatatatcaatcttgttaaggcaaatttggtgcacatagatgatatcgttgctgcacacatattcctcctggaatgcccaaaagcgaaaggacgttacatatgctcagcaattgatacaacaatccatgaattagctaaatatctctcattcaagtatccagaatttgaaatgccgatggattcgctcaaaggggtaccagaaatgcagccaattcatgtctcttctaagaagttgatggatttgggattcaagtttaaatatggtttggatgaaatatttgatggagcaattcaaagttgcaaagaaaaagggtttatgtag

SEQ ID NO: 382 - DNA, 921 bp, Nigella sativa
atggctgatgaggaacaacctagtaccaaattgagggcttgtgttattggaggaactggatacctggcgagtttcctcatcaagcacttgctgcagaaaggttatcatgtgaactctactgccaaagatccaggtaatccagaaacgatctcccaccttttggagttgcaaaatttgggtgagctgaaaatattcagagcagatttaactgatgaaggcagctttgatgaggcagtatctggatgcctcgtagtgtttcatgttgcaactccagtgcactttgattctgaagatcccgagaatgacatgatcaaaccagcaattcaagggacactaaatgttctcaaggcatgcacaaaggcacagacagtaaagcgtgtggttatgacatcttcggcagcagctgtgtccataaacaatattaataacacagatccggtgatggatgaagaatggtggaccgatgttcaatacttgtcttcagagaagccatttgcttggggatatccagtctcaaaggccctagcagagaaggcagcatggaaatatgcagaaaacaatgaaatggaccttatcactgtcatcccttctgtaatcgcaggtccatctcttactccaaatgttccaaacagcgtaagccttgccatgtcattgcttacaggaaatgaaagcctgatcaacggtttaaaaggaatgcaaattacatcgggttcgatttcactgttacacatagaggatgtggtaagagcacatatatttgtagctgagaagcaatcagctacaggtcgatacatttgttctgctgtcagtaccagtgttcctgagcttgcaaaatttctgagtaaacgatatccacaatatgtagttctttcagaacgagcctgtagctgcgaagtagtatcgggaggaggagttttatga

SEQ ID NO: 383 - DNA, 960 bp, Nigella sativa
atgcctgagtattgtgtaactggaggtactggattcatagccgcttacatagtgaaagaactgctccacaaaggttataatgtcagggcgacagtccgggacccaggggatgcagagaaggtcgggttccttctagaaatggatggagcaaaggaaagactcaagctggtaaaagctgatctcctggaagatggaagctttgatgatgcggtgcaaggagtagatggagtcttccatacagcatctccagttcttgttccctatgacgagaatatacaggaaactttgatcgatccatgcatcaagggaacagtaaatgttctcaagtcctgctccaaagcaagctcagtgaagcgggtggtactcacttcttcatgctcgtctataagatattgtgacgaagcgcaaaaagcgccccttaatgagtcccattggagtgatcctgagtactgcaaaagctataatctctggtatgcatatgcaaaaacattgggtgagaaagaggcttggcgactgtcaaaggagcttggaattgatctagtggtggtgaacccatcttatgttgttggtcctctgattgcaccacaaccaactagcacactcctcatgatactggggatcataacaggtgtaactgatgaatatccaaatacaatgattggttttgtacacattgatgatgtggtccgtgcacacattttggctatggaagaaagcagagcagcaggcaggcttatatgttcaagctcagttgtccactggtcagagatcattaagatgttaaaagacaagtatccatcctacccaatgccaacaaagtgctctgacaagaaaggagatgataccccacattccatggacaccagcaagatcaatgaattggggctcccagctttcaaaacagtccctcaaatgtttgatgattgcatcaagagctttcaagagaagggatttccgtga

SEQ ID NO: 384 - DNA, 1026 bp, Sanguinaria canadensis
atggaaatggaaggagagaaagggagtggtagtagagttgtatgtgtaacaggtggaggaggatatatagcatcatggctcatcatgagactccttcaacttggttactctgttcgagccactgccagattggacccaaaattgaagaaagacctcagccacctcacaaacctcccaagagcatcacaaaacctcaagatcttcaacgcggacctaaaccaaccagacagcttcactgctgccatcgaaggttgtgatggacttttccacgtagcgcacccccttgatttggaagactgtgaagttgacgatgcaaaggtgaatatgttagttgaaggaactctaggggttctcaaggcgtgtgtgaagtctaaaacagtgaagcgagttgtctacacttctagtgtggctactgttgttgctaacaaaactgggctcatggagatggatgaaagcatatggagtgacattgattttgttaaagcttataagtttcctggaagctcatatgttgcggctaagacattatcggaacaagcagcgattaagtttgctgaagaacatggtttggaacttgtgacagtgatttcttcgatggtcgccggtccattcatttgtccttcattgcccagctcagtgtgcatggctttggcattgatcatgggtaagagtgatcaatatatcaatcttgttaaggcaaatttggtgcacatagatgatatcgttgctgcacacatattcctcctggaatgcccaaaagcgaaagggcgttacatatgctcagcaattgaaacaacaatccatgaattagctaaatatctttcaatcaagtatccagaatttgaaatgccgatggattcgctcaaaggggcaccagaaatgcagccaattcatgtctcttctaagaagttgatggatttgggattcaagtttttaatggtttggatgaaatatttgatggagcaattcaaagttgcaaagaaaaagggtttatgtagatgtcttctagtactcgaattgccatag

SEQ ID NO: 385 - DNA, 1140 bp, Sanguinaria canadensis
atgggttctaccactcatgatcaagatgatcagatgatggtgatgatcaagggtcctgttgtagtgaccggagccgccggttattgcggttcgtggcttgtgatgaggcttcttcaacaaggttatactgttcgtgccacggttcgcgatcccactaaaatcgaaaaaacgaagcatttattggatataccaggggcaaaagaacgattaaccatatggaaagcagaccttgaagacgaaggaagctttgacgaagtgatagaaggatccatctatgttttccatctagccaccccaatggactttgaatcaacggatcctgagaatgaagtgatcaagcccacaatcgatggagttctaaatgtgatgaaatcgtgcaagaaagccaagactgtaaagcgtgttatattcaccacttctgcaggaacaatcaacgttgaaaaacaacaaaagccaatttacgatgaaacctcatggagcgaccttgagttctgcaggcagaccaagatgactggttggatgtattttgtgtcgaaaacattggccgagcaagctgcatgggactttgctaaggagaataacattcatttcattagcgtcataccgactctagttgtcggtcccttcatcacgaataacatgccgcctagcatgctcaccgcgctcgccttgatcacaagaaatgaagcacattattcaattctaaagcaaattcaatttgttcacctagatgacttgtgcaatgcccatattttcctagccgaacacccaaaagctgagggaagatacatatgctcttctgaagaccccaccatcttccaactagccaacatgctcagtgccagatatcctgaatttgacatccctaccaagtttgaaggtattgatgagtcaatcaagcccgtccatttttcgtcgaagaaacttaaagatctagggttccaatttaagtacaccatggaagacatgttcgatggagccattcaatcttgcagggagaagaaattgttcccatctgacttagaaaagaataatcaacactttgattatcagaaggaaattatagacctagcagcagccaaggagaagattcagatctcgtcagtgccagctccagaaaaaccaaccattatggcatag

SEQ ID NO: 386 - DNA, 1020 bp, Sanguinaria canadensis
atggattggaaggtgatcggaaagaagacggtatgtgttaccggtggcaccggttatgtcgcctcgttactcattaagaacttgctagagaagggtacttatgctgtcaatactactgctaggaatccagaggatcagaaaaaggttgctcatctcttaattctacaagcagatcatagtgacttaaaaattttccgagcagatttaaccgatgaggggagctttgacaccgccatcgctggctgcgatatcgtctttcatgttgcgactcctgtgaactttaattcacaagaccctgagaatgaaatgatcaatccagccatccacgggacgctcaatgtgttgaacgcgtgcgtgaaatctaagacagtgaagcgcgtggttttgacgtcgtcggcagctgccgtgtctataaataatcagaacggaacaggttttgtgatggacgaaggatgctggacggacgtcgagttcttagcttccgcaaaaccacctatttggggatatccagtgtcaaaaacacaagcagagaaggcagcctggaaatttgcagaagaaaacaagatagacctcatcacagtcatcccttctctaatgctgggcccatcacttactcttgctgtcccctccagtatctttcttggaatgtcattgctcacagggaacaatgaactgatcaacaccttgaaaggcatgcaaatgctatcgggctcgatctcgataacacacgtagaggatgttgttaatgctcacatatttctagctgagaaggaatcggcttctggccgctacatttgctgcaacatcagcagtagccttcctgagctggcgaagttactcagcaatcgatacccacagtacaaagtccctactgatttcagagattttcctacaaaggccaagctgagtctttcatcagaaaagcttattaacgaagggttcagcttcaaatacggaatcgaggaaatttacgatcaaaccatggagtactacaaatctgtagaacttctgcagaaatga

SEQ ID NO: 387 - DNA, 966 bp, Sanguinaria canadensis
atggcggaggagtactgtgtgacgggagggactggattcatagcggcttacatagttaaagcattactggagaaaggccacagggttagggcaacagtgcgagacccagacaaggtggaaaaggttggattcctttgggagtttactggggcaaaggaaagattaaagctggtaaaagctgatcttatggtggaggggagcttcgacgaggccatagatggcgtggacggtgtcttccatacagcatctcctgttctcgtgccttacgacactgacattcaggcgactttgatcgatccaagtataaagggaacgatgaatgttctgagatcctgctctaaatcaagttcccttaagcgagttgtgcttacctcttcttgttctgctgtgagataccgctatgatgttcaacaagtctcccctctaaatgaatcacattggagcgatcctgaatactgcaaaagctacaacctatggtacccgtacgcaaagacattagccgaggaacaggcttggaaattggccaatgagagtgggattgatctagtagtagtgaacccatcttacgtcgtgggtcccctgattgcaccatatccaaccagcacactccttatgatactgggaatcataaaaggagtgcaaagcgaatatccaaatttggcagtgggttttgtacacatagacgatgtggtagctgcccacatcctagccatggaggagagtaaagcatcaggcaggcttatatgttcaagttcagtcgctcacttctcagagatcattgaaatgcttaagtccaaatatccatcctacccaattgtaaacaagtgcaatgacaagaaaggagatgacattccacatagcatggacaccagcaagattcgtcagttggggttccctgcttttaaaactattcctgaaatgttcgaagactgcatcaaaagcttccaggaaaagggatttctgtga

SEQ ID NO: 388 - DNA, 1125 bp, Stylophorum diphyllum
atgggttctataaatatagatccgacgatgatgaagaaagggcctgttgtagtgactggggctaccggttattgcggttcgtggcttgtgatgaggcttcttcaagaaggttatattgttcgtgccacagttcgcgatcccagtaaaatcgaaaagacgaagcatttactgggtctacctggggcaaaggaacgattgaccttatggaaagcagaccttgaagacaaaggaagctttgatgaagtgatagagggatccatctatatgttccatcttgccactccaatggactttgagtcaacagatcctgagaatgaagtgattaagcctacaatcaatggagttctaaatgtgatgaagtcgtgcaagaaatctaagaccgtcaagcgtgttatcttcacaacttctgcgggaaccgtcaatgttgaagagcaccttaagccagtttatgatgaaacctcatggagtgatgttgagttctgcaggcggatcaaaatgactggttggatgtattttgtgtcaaaaacgttggccgagcaagctgcgtgggactttgctaaggagaacaacattcatctcattagtgtcataccaacactagttgtaggtcccttcatcatgaatagcatgccacctagcatgatcaccgcgctcgccctaatcacaggaaataaagcacattattcaattctaaagcagattcaattagttcatctagacgacttgtgtaatgcccatatttttgtcgccacacatccaaaagccgagggaagatacatttgctcttctgaagaccccaccatcttccaactagccaacatgatcagagacagacatccagaattcgacatccctacaaagtttgaaggtatcgacgaggcgattaagccaatacatttctcttcgaagaaacttaaagacctagggttccaattcaagtacactatggaagacatgtacgatggagccattcagtcgtgcagggagaagaaattgttcccacctgagttggaaaagaataagaagcagtatgatcatcagaaggaagtactagtcaaggagaagaagatctcaacagcagtgcccaatgcagttctacaagagatagaaaagaatattaattag

SEQ ID NO: 389 - DNA, 963 bp, Stylophorum diphyllum
atggcggaatactgtgtaacaggagggactggattcatagcttcttacctagtgaaagctttacttgaaaagggtcacagggttagggcaacagttcgagacccagagaatgtggaaaaggtaggattcctttgggaatttactggagcaaaggaaagattaaagctggtaaaagctgatcttatgatggagggaagcttcgacgatgctgtaaatggcgtggatggtgtcttccatacagcatctcctgttaacgtgccttacgacaatgatgttcaggcaactttgatcgatccaagtataaagggaacgatgaatgttctgaaatcttgtgctaaagcaagctctattaagcgagttgtgcttacctcttcttgttctgctgtgagataccgctatgatgttcaacaagtctccccccttaacgaatcgcattggagcgaccctgaatactgcaaaagctacaatctatggtacccatactcaaagacattagccgaagaacatgcatggaaatgggccaaggagagcgggattgatctagtagtggtgaacccgtctttcgtcgtgggtcccctgattgcaccatatccaaccagcacactccttatgatattgggaataataaaaggaatgcgaggcgaatatccaaatttcagattgggttttgtacacatagatgacgtggttgctgcccacatcttagccatggaggagagtaaggcatcaggcaggcttatatgttcaagttccgttgctcacttctcagagatcattgaaatgctcaagtctaagtacccatcctacccatttgaaaacaagtgctgtgatcggaaaggagacgacaatccacacagtatggataccagcaagattcgtcagttgggcctccctgcttttaaaactattcctgaaatgttcgaagactgcatcaaaagcttccaggaaaagggatttctgtga

SEQ ID NO: 390 - DNA, 966 bp, Stylophorum diphyllum
atggctaaaggcacggtctgtgtaactggtgcatcgggtttcctggcttcttggctcatcaagcgacttctgttatctggctatcatgtcgttggcactgttagagaccctggaaatgacacaaaactggctcacctatggaacttacaaggagcaaaggagaggctccggctagttaaagccgaattaacagaagagggaagctttgacgatgcaatcaaggggtgtgagggtgtctttcacatggcttcccccgttcttggacagcctactgatcctcaggacatcttaaagccagctattgatggaactcttaatgtgttacgttcgtgtaaaaagaatccgtcactaagacgagtggttctcacatcatcgtcttccacaatcagagtaagagaaaagttagaccccaaaaatcctttggacgagtcatcttggagctcagttgaactctgttctaaactcaagatttggtatgtactatcaaaaacaatggcagaaaaggcagcatgggagttctgtaacgaaaatgggatcaatctagtgacggttagcccttcatttgttgtaggaccaagcttaccacctgctttatgctctacagcatcagatatcttgggcttgcttcaaggtgaaactgagaggttttattggcatggaaggatgggatatgtccatatagatgatgttgctctatgtcatattctagtttatgaacgtgaagaagctgaaggacggtatctatgcagctcgactgtcgttgataatgatgaactcgtgtcaattctgtcagcacgctatcctacactacctataccaaagaggtttgagcagcatgaaagaccctattatgacttcaacacgaacaagattaagagtttagggttcacattcaaatcgattccagagatgtttgacgactgtatcacatctctagtggcacaaggccatctgtcgataccttag

SEQ ID NO: 391 - protein, 335 aa, Argemone mexicana
MEGEKGIVCVTGGAGYLASWLIKRLLQHGYTVRTTVRSDPQFKEDISHLKSLPEASKNLQVYEADLDKPKSFDDVINGCIGVFHVAHPIDFEGNKMSQDKAIKISIEGTLGILKACLKSKTESRTAVKRVVYTSSVAAAVFISNKKDVEEINENIWTEVETLKKNEFTRNGYLISKTLTERSALKFAEEHDLDLVTLLPSMIVGPFLTSNLPFSLTISQALVLDNKENCKILKNLNNAVHIDDVASAQIYLFECPEAKGRHICSSVDITIHDIAKLMSIKYPELQLPTDLLMEIEEEKPVHISSKKLLNLGFKFKYGFEDMYSDAIQCCKDKGFL

SEQ ID NO: 392 - protein, 320 aa, Argemone mexicana
MAEYCVTGGTGFIASYIVKALLEKGHKVRATVRDPDNVEKVGYLWEMPGAKERLKLVKADLMVDGSFDDAVNGVDGVFHTASPVLVPYDNDVQATLIDPTIKGTRNVLKSCSKASSVKRVVYTSSCSAVRYRYDVQQVSPLNESHWSDPQYCKNHNLWYAYAKTLAEEEAWKIAKESGIDLVVVNPSFVVGPLIAPQPTSTLLLILGIVKGLRGEYPNLTVGFVHIDDVVAAHILAMEETKAAGRLICSSSVAHFSEIIGMLKSKYPSYPYENKCGDQKGDNNPHSMSSNKIQQLGLPPLKNLNEMFEDCIKSFQNQGFL

SEQ ID NO: 393 - protein, 328 aa, Berberis thunbergii
MENGGEKGSVCVTGGAGYLASWLIMRLLENGYSVRATARLDPKFNEDVTHLKAFPHASEKLQIFDADLNKPDSFNDVIEGCVGVFHVAHPIDLEGKRPEASVTKTAVDGALGILKACLQAKTVKKVVYSSSMAAAVISKLNVQEIDESQWTDVDFCRTLDVPGISYVISKTVTERESIKFAKEHGLQLVTMLPALIVGPFSSPRIPESVAIALSLFNGDPEKPLPAWNTNLVHVDDVVAAQIFLFESPKAEGRYVCCSTNTTVPELAKFITGKYPELKVRPELLSDVGSENIVRLSSNKLLGLGFEFKHGLEGIFDGAIQCCKEKNLL

SEQ ID NO: 394 - protein, 326 aa, Berberis thunbergii
MDVKGKVCVTGASGYMASWLIKRLLLSGYHVCGTVREPGNSKKVAHLWQLEGAKERLQLLKADLMEDGSFDDAVMGCHGVFHTATPVLTPNMVKSDPKAKILAPAIKGTLNVLRSCKKNPYLKRVVLTSSSTAIRVRDEVDPNIPLDEMSWSSVERCQRLQIWYALSKVLAEKAAWEFAEEEGIDLVTVLPSFIIGPSLPLDLSLTASDILGLLNGVSERFTQLGRMGYVHIDDVALCHILVYEESSAQGRYLCSSVVLDNNDLASFLALRYPSLPIPKRFEQLDRPSFDFNTSKLKSLGFNFKGIEEMFDDCVASLKEQGHISQT

SEQ ID NO: 395 - protein, 320 aa, Berberis thunbergii
MPEFCVTGGTGFIAAYLVKALLEKGYNVRATVRDPEDVEKVKFLWEMNGAKERLKLVKADLMVDGSFDDAIQGVDGVFHAASPVLVPQDDHIQETLIDPIIKGTINVLSSCSKSRTVKRVVLTSSCSSIRYHYDVQNVSPLNETHWSDPEYCKHYNLWYAYAKTLGEKEAWRLAEEKGINLVVINPSFVVGPLIAPQPTSTLLMILRIIKGKLGEYPNTALGFVHIDDVVSAHMLAMEESEASGRFICSSKVAHWSDIIKMLKAKYPSYPIETKCAKKKGDDKLHSMDTSKIEQLGLRAFKTLPQMFDDCIKSFQDKELL

SEQ ID NO: 396 - protein, 333 aa, Chordyalis celanthifolia
MEGGGEKEKGTVCVTGGAGFLASWIIMRLLQHGYTVRTTFRSDPEFKEDVSHLNALPGASEKLEIFEADLGKPGSFTEAINGCIGVFHVAHPNDFTGKTTQDQMVKLSVEGTLGILKACLDSKTVKRVVYTSSIAAAGLMNDAKDVKEMTEQIWTEVDAFRTLNIPGISYAVSKTLTERAAIEFAEENGLDLVTLLPSMVVGPFMGSNLPTSVSLGLSLVFGDEELLKAIKPSCSSVHVDDVASAEIFLFECPEAKGRYICSAAENTIHDLVKFLTVKYPELQLHTHLLKEIGEAKPGHVSSKKLMSMGFKFKYGFEETYDEAIKCCKAKGLI

SEQ ID NO: 397 - protein, 331 aa, Chordyalis celanthifolia
MGVQRERGIVCVTGGAGFLASWIIKRLLERGYSVRTTIQSNPDFKEDVSHITSLPGASKKLQIYEADLGKPDSFSEAINGCIGVFHVAHPTDFTGKTSQEEMIRISVEGTLGILRSCLDSKTVKRVIYTSSTVAAGLGTSIEDTKVINEQMWTNVDAFKSTLNAPGISYAVSKTITERAAIDFAHERGLDLVTLLPSMVIGPFLGSYLPMSVSFALSLIFGNEELLKHMKPTSVVDIDDVASAQIFLFESSEAKGRYICSAGEKTIHEVARFLQKKYPELQMQTEILKEIEEEEPVHTSSKKLTSLGFNFKYGFEEMYDNTIKCCKQKGLL

SEQ ID NO: 398 - protein, 332 aa, Chordyalis celanthifolia
MGVQLEGGIVCVTGGAGFLASWIIKRLLEQGYSVRTTIQSDPEFKEDVSHITSLPGALEKLKIFEADLGKPDSFSEAIDGCIGVFHVAHPIDLSGKTSQEQMIKLSVEGTLGILKSCLDSKTVKRVIYTSSTLAAGLGTSFEDTKEINEQMWSNIDALINSTDNAPGTSYAISKTLTERAAIDFAEEHGLDLVTILPSMIVGPFICPNLPNSIAYALSFVFGNEELLKYLTPTSVVHVDDVASAQIFLLECSEAKGRYICSVGEKTIHEVTKFVQTKYPELKVQTQVLKEIEDEQPVHTSSKKLISMGFKFKYGLEELYDETIQCCKEKGFL

SEQ ID NO: 399 - protein, 331 aa, Chordyalis celanthifolia
MGGQREREIICVTGGAGFLASWIIKRLLEHGYSVRTTVQSNPEFKEDVSHITSLPRASKKLKIYEADLEKPDSFFDAINGCTGVFHVAHPTDFTGKTSQEQMIKISVDGTLGILKSCLDSKTVKRVIYTSSTVAAGLGLSINDTEAINEQMWTDVDTFKNTLNAPGISYAVSKTITERAAIDFAREHGLDLITLLPSMVIGPFLGSNLPMSVSFALSLIFGNEELLKHMKPTSVVDIDDVASAQIFLFECSEAKGRYICSNGEKTIHEVARFLQKKYPKLKIQTEILKEIEEEEPVHTSSKKLLSLGFKFKYEFEEMYDETIKCCEENGFL

SEQ ID NO: 400 - protein, 344 aa, Chordyalis celanthifolia
MGATVIDQENTDDQEMVMRKGPVVVTGAAGYIGSWLVMRLLQHGYTVRATVRDPTNVGKTKHLVELPGAKERLTIWKADMDDEGSFDDVVRGCTCFFHLATPMDFESNDPENEVIKPAINGVLNVMRSCKKSTTLKRVVFTTSAGTVNVEEVQKPSYDETNWSDIDFCRRTQMTGWMYFVSKTLAEKAAWDFAKENNMDLITIIPPLVVGPFIMNSMPPSMITALALITGNEAHYSILKQIQLIHLDDLCNAHIFLYEHPKAEGRYICSSADPTIYELAKMLKEKYPEYNIPTKFEGIDESIKRVHFSSKKLTDLGFQFKYTMEDMFDGAIQTCREKNLLPLQS

SEQ ID NO: 401 - protein, 338 aa, Chordyalis celanthifolia
MSITRKKTVCVTGGTGYIAGVLIKKLLEKGYAVNTTVRNPDDEKKISPLLKLQGKYNDLKIFKADLTIEGSFDEAIACCHFVFHVATPIHVHSEDPENDMIKPAVQGTLNVLNSVTKAETVKRVVLTSSATTLSINKLNGVGYVIDEKSWTDVEFLTSEKPPNWGYAAMKTLVEKAAWKFAEENKIDLITIILPLVTGQSLTPEHEPPSMPFAMALLTGNNDLINVMKDLQMLLGSVAMIHLEDAVECHIFLAENESAYGRYNCCPINTGLVELGKFFENRYPQYNVHTDFGDFPAQAKLSISSEKLINAGFKFQHIGLEEIYDESVEYYIALGLLQK

SEQ ID NO: 402 - protein, 329 aa, Chelidonium majus
MEGEKGTVCVTGGAGFLASWLIMRLLQYGYSVRTTIRSDPKFKEDISHLKARPKAQEKLQIFEADLEKPESFDEAIDGCVGVFHVAHPIDFEGKISQDKMIKTSVEGTIGILKSCLKYKTVKRVVYTSSMGAAMFVSNILDVKEVDENMWTEVDNFKNIPLPGVPYAMSKTITERAAIEFAEEHGLDLVTLLPGMIVGPFLGPNLPISLSLALSMVFGNDEYTKIMRQTNVVYIDDIACAQIFLLECPNAKGRHICSALDITIHDVAKFISFKFPELQLPISLLKEIQEEKPIHVSSEKLLSLGFKFKYGFEDMYDGAIKCCKEKGFLR

SEQ ID NO: 403 - protein, 328 aa, Chelidonium majus
MEGGSDEKKGTVCVTGGAGYIGSWLIMRLLERGYSVRATVRLDPGLNRDISHLTNLPGASDKLQIFNADLKNPQSFDTAIEGCIGVFLVAYPGNMDQIEIDDVANEMLEEVTLELLRACLKSKTVKRVVYTSSAAAVLVNDKGLMEMDESSWSDVEFCRNVKLRGSSYIITKTLIEQAALKFAEENGLDLVSIIPPMVVGPFICPHLPDSVSMALSIILGNRHPYFAVMQMVHIDDIVSGHIFLFECPNAKGRYICSSMETSVHDIAKFFTTHYPEFELPMNLISEMKEEKPIHLSPKKLLSLGFKFKYDFKDMFDGAIQSCKEKGFL

SEQ ID NO: 404 - protein, 320 aa, Chelidonium majus
MAEYCVTGGTGFIASYLVKALLEKGHRVRATVRDPENVEKVGFLWEFTGAKERLKLVKADLMMEGSFDDAVNGVDGVFHTASPVNVPYDNDVQATLIDPSIKGTMNVLKSCAKASSIKRVVLTSSCSAVRYRYDVQQVSPLNESHWSDPEYCKSYNLWYPYSKTLAEEHAWKWAKESGIDLVVVNPSFVVGPLIAPYPTSTLLMILGIIKGMQGEYPNFRLGFVHIDDVVAAHILAMEESKASGRLICSSSVAHFSEIIEMLKSKYPSYPFENKCCDRKGDDNPHSMDTSKIRQLGLPAFKTIPEMFEDCVKSFQEKGFL

SEQ ID NO: 405 - protein, 328 aa, Eschscholzia californica
MEGEKKVVCVTGGAGYLASCLIMKLIQRGYYVRATIRSDPKFNEDVSHLKAIPGAQEKLEIFDADLEDPESFDNIMEGCVGVFHVAQPIAFGGSKEILEKIIKTSLEGTLGILKACLKSKTVKKVVYTSSKAAALDFKNEAKEIDENTWTDVETLRKNEVGDGWYPISKTLSENAALDFAEEHGLDLVTILPSMIVGGFLSSTLPLALRLSLALVLGTEVECRLLAQAGNVVHIEDVVSAHIFLFERPEAKGRYICSSNDITIHDVAKFISVKYPELKLPTELLEEFGKEKAIHYSSKKLLDLGFKFKYGFEDMYTDAIECCKEKGFL

SEQ ID NO: 406 - protein, 331 aa, Glaucium flavum
MEGGGGEKGTVCVTGGAGFLASWLIKRLLQHGYSVRTTVRSDPKFKEDITHLQVLPGAQEKLQIFEADLEKPDSFDNAIDGCVGVFHVAHPIDFEGKISQDTMIKTSVEGTLGILKSCLKAKTVKRVVYTSSMGAAMFIRNIKDVKEIDESMWTEVDIFKHFEGYGMSYAVSKTLTERAAIEFAEEHGLDLVTILPGMVVGPFDGPNLPVSLSMALALILGNEELAKLMRQANVVHIDDIASGQIFLMECPEAKGRHICSATDITIHGVAKLISIKFPEIQLPIDLLKEIEEEKPIHVSSDKLLSLGFKFKHGFEDMYEGAIRCCKEKGFL

SEQ ID NO: 407 - protein, 354 aa, Glaucium flavum
MHIYKNEPSRYTSSQYEKGERRMEGEKGIVCVTGGAGHLASWLIMRLLQHGYFVRTTVRSDPKFKEDISHLKSLPEAAEKLEVFEADLEKPESFSEAINGCIGVFHVAHPMEYEQKVSQETIIKISVEGTLGILKSCLKSKTVKRVVYTSSIAAAISMSNDIKEINENVWTEVDIVKNLEGPTVSYAVSKTLTERAALEFAEEHGLDVVTILPSIIVGPSISNNLPVSTALALSSILDQEEYKTLKKAPKPPAAVHIDDIVSAEIFLFESPKAKGRYICSTVDITARDVAKFIATKYPELLLSTDLSKEFKEEEEEKPVHISSDKLLSIGFKFKYGFEDMYDDAIQYCKEKGFL

SEQ ID NO: 408 - protein, 328 aa, Glaucium flavum
MEGGRDDEKGIVCVTGGTGYIGSWLIMRLLERGYTVRATVRLDPGHNRDISHLTSLPGALEKLQIFNADLQNPQSFNAAIDGCVGVFLVAYPINLDQIEVDDAANGKIVLGTLELLKACLKSKTVKRVVYTSSAATLMVNDKGLMELDESSWSDVEFCRTVKAYGSSYIIPKTLIEQAALKFSEENGLDLVSIIPPMVVGPFICSHLPGSISMAMALILGNRYPRVPITQMVHIDDIVSGHIFLFECPEAKGRYICSSLETSIHDVAKFFTIHYPEFEMPMNLLSEMKEQKPFHLSPKKLLSLGFKFKYGLKDMFDGAIQSCREKGYL

SEQ ID NO: 409 - protein, 378 aa, Glaucium flavum
MGSLSTTSEDQKMMSKGPVVVTGAAGYCGSWLVMRLLQQGYTVRATVRDPTKIEKTRHLLDLPGAEERLTIWKADLEDEGSFDEVIDGSIYVFHLATPMDFESIDPENEVIKPTIHGVLNVMKSCKKAKTVKRVVFTTSAGTVNVEEHQKPVYDETSWSDIEFCRRVKMTGWMYFVSKSLAEQAAWDFAKKNNIDLISVIPTLVVGPFIMNSMPPSMLTALALVTGNTAHYSILKQIQLVHLDDLCNAHIFLAEHPNAKGRYICSSEDPTIFQLANMLKDRYPEFDIPTKFEGIDESIKPVHFSSKKLKDLGFQFQYTMEDMYDGAIQSCREKKLFPPGLEKDRQNEKKEVTSKVVKEENEKITSVHAVSHAKPAIMA

SEQ ID NO: 410 - protein, 330 aa, Hydrastis canadensis
MEEEKGIVCVTGGAGCVASWLIMRLLQHGYSVRATVRSDPMFKEDTSHLLNLPEAPEKLQIFDADLENPESFEAAINGCIGVFHLSHPMDFEGKIPLDTLIKTSIEGTLGILKACLKSKTVKRVVYTSSISAAMCISNMNETGQIDESMWSDLDMVRSHNFPAVSYIVSKTLTESAVLEFSKEHGLDVVTILPSAIAGPFLTSYLPVAFSQSLPLIFGKEVQLINMTNTNLVHIDDVASAQIFLFECPIAEGRHICSTIDLSIHGLAKLLSNKYPELELQIPTDDLSKMEETKPLHLSSKKLLNLGFKFKYDLEEMFDGTIQCCKEKGFL

SEQ ID NO: 411 - protein, 353 aa, Hydrastis canadensis
MVAEGDSVCVTGAAGFIGSWLVMRLLERGYMVKATVRDPDNIKKVKHLLDLPNAKTSLTLWKADLVDEGSFDDAIKGCTGVFHVATPMDFESKDPENEVIKPTIEGMLNVMRSCVKAKTVRRLVFTSSAGTVNVHQHPQQPKYDENCWTDVEFCRNKKMTGWMYFVSKTLAEKAAWEFAKDNNLDFISIIPTLVVGPFLMSSMPPSLITALSPITGNEAHYSILKQIQLVHLDDLSNAHIYLFEHPEANGRYICSSYDSTIIDVANVLRQKFPEYNVPNKFKDVDENLKAVAFSSKRLIDLGFKYKYSKEDMFVEAIVSCREKGLLPLCSETQVNDKSMECEKREARSEGGSD

SEQ ID NO: 412 - protein, 317 aa, Hydrastis canadensis
MERVCVTGAGGFQASWLVNLLLSKGYMVHGTVRNPDDEKNAHLKELEKASENLKLFKADLLDYDSLFAAINGCSGVFHVASPVPSGAVPNPEVELIEPAVTGTSNVLKACSMAKIKKVVYVSSIAAVMLNPNWPKDKLMDESCWSDKEFCKTTENWYCLSKTEAESQALDYAKKSGLEVVTVCASIIIGPMLQSKMNASSLLLLRMLKDGLETLDNKIRMFVDVRHVAEALLLVYKKPEAEGRYICSAFTLTMKDLNEKLKTMYPNYNYPKQIVGVDEAWDISSEKLLNLGWKYRPLEDTLIDSIKNYQEKGLLHKV

SEQ ID NO: 413 - protein, 326 aa, Jeffersonia diphylla
MEGKTGTMCVTGGAGYLGSWLVMKLLKRGYSVRATVRLDPEHKKDLSHLKNLPGASEHLKFFNADLNKPDSFDAAIEGCDGVFHVAHPLDFQGNEADPARISMAVEGTLGILKACVNSKTVKRVVYTSSVAAVVLNTTGLMEMDENSWTDLELVETIKAPGSSYIVPKTLAEQAAIKFAQEHGLDLITVAPSLIVGPFICPHFPTSVFLALAVLMGKTDKFQYISITSMVHIEDIVAAHIFLLECPNAKGRFICSALDTTIHDLAKFLSSKYEDFEMPIDSLKEIEERKPLHLSSKKLLDLGFTYKYGLDEIYDGAIQCCKEKGLM

SEQ ID NO: 414 - protein, 333 aa, Jeffersonia diphylla
MPKKAAVDQKMDFKGKVCVTGASGYLASWLVKRLLLSGYHVKGTVRDPGNSKKLAHLWQLDGAKERLELVKADLMEDGSFDDAIMGCCGVFHTASPVLGPESDPKAEILDPAVNGTLNILRSCKRNPGLKRVILTSSSAAVRVRDDFDPNIPLDETSWSSVEICERFQIWYALSKILAEKAAWEFAKENGIDLVTILPSFLIGPSLPHDLCSTASDVLGLLTGGPNKFSFHGRMGYIHIDDVALCHILLFEEAKAHGRYLCSSFVMDNNDLASFLAQRYPYLPITKRFEPLDRPCYEFNTSKMKSLGFKFKGIEEMFDDCVASLKEQGYILQK

SEQ ID NO: 415 - protein, 327 aa, Jeffersonia diphylla
MSIGAGKVVCVTGASGYIASWLVKLLLERGYTVKASVRDPNDYNKTVHLRALSRANERLQLFKANLLEEGSFHSVIDGCEGVFHTASPFFHNVTDPQAELIDPAVNGTLNVLGSCAKIPTVKRVVVTSSAAAVVYNGKPRTPEVVVDETWFSDAELCKNLKLWYVVSKTLAEESAWKFAEKNGIDMVAINPAMVIGPLLQPTLNTSAEAILNIIKGGETFPNRTLGWVHVKDVANAHILAFENSSATGRYCLFESVAHYSELVRILRELYPGLKLPEKSEDDKPFAPTYQVSREKAKGLGIDFIPLEIGLKETVESLKEKKFVSFEV

SEQ ID NO: 416 - protein, 325 aa, Menispermum canadense
MSSGAKKVVCVTGGSGYIASWLVKLLLERGYTVKASVRDPNDPKKIGHLLALPGANERLKLLKADLLEEGSFDSVIDGCEGVFHTASPFFHAVTDPQTELIAPAVKGTLNVLSSCAKTPSVKRVVVTSSMAAVLYYGKPRTPEVVVDETWYSDPEFCKESKLWYVVSKTLAEEAAWKFAKENGLDIVTINPAMVIGSLLQPTLNTSAAAVLNLINGSETFPNYTFAWVHVKDVATAHILAFETPSASGRYCLVERVAHYSDVVKVLHDLYPNLSLPQKCADDKPFVPTYQVSIEKAKGLGIDFIPMEVSLKETVEGLKEKNMISF

SEQ ID NO: 417 - protein, 321 aa, Menispermum canadense
MEGANERVCVTGAGGFVASWLVKLLLSKGYTVHGTVRDPRDKKNAHLMKLKEGYEKLQLFQADLMNYSSLCAAITGCNGVFHVATPVPPGSDAVLEAELVEPAIVGTLNVLKACSEAKVKRVVVVSSSAAVEMNPNWPKDQVMDETCWSDKEYCKQTKNWYFFSKTVAENEALEYSKGTGLDVVTVCPSIVIGPMLQSTVNGSSLVLIKILKDGIDRVENKVRMLVDVREVAEALLLTYKKPEAQGRYLCVSYMIRMKDLVEKLRSVYPNYNYPKNFTEVEEEDKLSSAKLQSLGWKFRPLEETLADSVKSYQEAGILDKD

SEQ ID NO: 418 - protein, 329 aa, Nandina domestica
MEGGDKGTVCVTGGAGFLASWLITRLLRHGYSVRATVRSDPKFKEDTTHLMNLPEAQEKLAIFDADLEKPGTFEPVVEGCIGVFHVAHPMDMEGKTPQETITKISVEGTLGLLNACLKSKTVKRVVYTSSTAAAMCVSNLKELQEIDENMWSDVEMLKGLSLPGLSYSISKTLTERAAIEFGAKNGLDVVTLLPAAIVGPFHTPNIPIGVALALALVFGNELACQLAKQLNIVHIDDVASAQIFLLECPKAVGRHICSSADTTIHGLAKFFSARYPEFQMPIDLLSKMEEEKPIHLSSKKLLDLGFKFNNGIEKMYDGAIESCKQKGFL

SEQ ID NO: 419 - protein, 332 aa, Nandina domestica
MEMEGEKGSGSRVVCVTGGGGYIASWLIMRLLQLGYSVRATARLDPKLKKDLSHLTNLPRASQNLKIFNADLNQPDSFTAAIEGCDGLFHVAHPLDLEDCEVDDAKVNMLVEGTLGVLKACVKSKTVKRVVYTSSVATVVANKTGLMEMDESIWSDIDFVKAYKFPGSSYVAAKTLSEQAAIKFAEEHGLELVTVISSMVAGPFICPSLPSSVCMALALIMGKSDQYINLVKANLVHIDDIVAAHIFLLECPKAKGRYICSAIDTTIHELAKYLSFKYPEFEMPMDSLKGVPEMQPIHVSSKKLMDLGFKFKYGLDEIFDGAIQSCKEKGFM

SEQ ID NO: 420 - protein, 306 aa, Nigella sativa
MADEEQPSTKLRACVIGGTGYLASFLIKHLLQKGYHVNSTAKDPGNPETISHLLELQNLGELKIFRADLTDEGSFDEAVSGCLVVFHVATPVHFDSEDPENDMIKPAIQGTLNVLKACTKAQTVKRVVMTSSAAAVSINNINNTDPVMDEEWWTDVQYLSSEKPFAWGYPVSKALAEKAAWKYAENNEMDLITVIPSVIAGPSLTPNVPNSVSLAMSLLTGNESLINGLKGMQITSGSISLLHIEDVVRAHIFVAEKQSATGRYICSAVSTSVPELAKFLSKRYPQYVVLSERACSCEVVSGGGVL

SEQ ID NO: 421 - protein, 330 aa, Nigella sativa
MSSSTTTEGAGKTVCVTGGSGYIASWLIKLLLQRGYTVKATVRDPNDPRQTMHLRELCGAGERLSLFKADLLSEGVFDSIVNDCDGVFHTASPCYFEAKDPQAEIVEPAVKGTLNVLRSCTKSPSVKRVIVTSSIAAVLNNGKLRTPDVVVDETWFSDPEVCKELKLWYPLSKTLAEESAWKFAKDHGIDMVSINPAMVIGPLLQPTLNSSSSIILNLINGAKTYTNAAYGLVDVRDVANAHILAFEVPSATGRICLAEKVCHFSEMVEILHELYPDIQLPTKCATDEPFVQPYQLCTEKARSLGINFTPIGVSLKETVESLKAKKFVNL

SEQ ID NO: 422 - protein, 319 aa, Nigella sativa
MPEYCVTGGTGFIAAYIVKELLHKGYNVRATVRDPGDAEKVGFLLEMDGAKERLKLVKADLLEDGSFDDAVQGVDGVFHTASPVLVPYDENIQETLIDPCIKGTVNVLKSCSKASSVKRVVLTSSCSSIRYCDEAQKAPLNESHWSDPEYCKSYNLWYAYAKTLGEKEAWRLSKELGIDLVVVNPSYVVGPLIAPQPTSTLLMILGIITGVTDEYPNTMIGFVHIDDVVRAHILAMEESRAAGRLICSSSVVHWSEIIKMLKDKYPSYPMPTKCSDKKGDDTPHSMDTSKINELGLPAFKTVPQMFDDCIKSFQEKGFP

SEQ ID NO: 423 - protein, 341 aa, Sanguinaria canadensis
MEMEGEKGSGSRVVCVTGGGGYIASWLIMRLLQLGYSVRATARLDPKLKKDLSHLTNLPRASQNLKIFNADLNQPDSFTAAIEGCDGLFHVAHPLDLEDCEVDDAKVNMLVEGTLGVLKACVKSKTVKRVVYTSSVATVVANKTGLMEMDESIWSDIDFVKAYKFPGSSYVAAKTLSEQAAIKFAEEHGLELVTVISSMVAGPFICPSLPSSVCMALALIMGKSDQYINLVKANLVHIDDIVAAHIFLLECPKAKGRYICSAIETTIHELAKYLSIKYPEFEMPMDSLKGAPEMQPIHVSSKKLMDLGFKFLMVWMKYLMEQFKVAKKKGLCRCLLVLELP

SEQ ID NO: 424 - protein, 379 aa, Sanguinaria canadensis
MGSTTHDQDDQMMVMIKGPVVVTGAAGYCGSWLVMRLLQQGYTVRATVRDPTKIEKTKHLLDIPGAKERLTIWKADLEDEGSFDEVIEGSIYVFHLATPMDFESTDPENEVIKPTIDGVLNVMKSCKKAKTVKRVIFTTSAGTINVEKQQKPIYDETSWSDLEFCRQTKMTGWMYFVSKTLAEQAAWDFAKENNIHFISVIPTLVVGPFITNNMPPSMLTALALITRNEAHYSILKQIQFVHLDDLCNAHIFLAEHPKAEGRYICSSEDPTIFQLANMLSARYPEFDIPTKFEGIDESIKPVHFSSKKLKDLGFQFKYTMEDMFDGAIQSCREKKLFPSDLEKNNQHFDYQKEIIDLAAAKEKIQISSVPAPEKPTIMA

SEQ ID NO: 425 - protein, 339 aa, Sanguinaria canadensis
MDWKVIGKKTVCVTGGTGYVASLLIKNLLEKGTYAVNTTARNPEDQKKVAHLLILQADHSDLKIFRADLTDEGSFDTAIAGCDIVFHVATPVNFNSQDPENEMINPAIHGTLNVLNACVKSKTVKRVVLTSSAAAVSINNQNGTGFVMDEGCWTDVEFLASAKPPIWGYPVSKTQAEKAAWKFAEENKIDLITVIPSLMLGPSLTLAVPSSIFLGMSLLTGNNELINTLKGMQMLSGSISITHVEDVVNAHIFLAEKESASGRYICCNISSSLPELAKLLSNRYPQYKVPTDFRDFPTKAKLSLSSEKLINEGFSFKYGIEEIYDQTMEYYKSVELLQK

SEQ ID NO: 426 - protein, 321 aa, Sanguinaria canadensis
MAEEYCVTGGTGFIAAYIVKALLEKGHRVRATVRDPDKVEKVGFLWEFTGAKERLKLVKADLMVEGSFDEAIDGVDGVFHTASPVLVPYDTDIQATLIDPSIKGTMNVLRSCSKSSSLKRVVLTSSCSAVRYRYDVQQVSPLNESHWSDPEYCKSYNLWYPYAKTLAEEQAWKLANESGIDLVVVNPSYVVGPLIAPYPTSTLLMILGIIKGVQSEYPNLAVGFVHIDDVVAAHILAMEESKASGRLICSSSVAHFSEIIEMLKSKYPSYPIVNKCNDKKGDDIPHSMDTSKIRQLGFPAFKTIPEMFEDCIKSFQEKGFL

SEQ ID NO: 427 - protein, 374 aa, Stylophorum diphyllum
MGSINIDPTMMKKGPVVVTGATGYCGSWLVMRLLQEGYIVRATVRDPSKIEKTKHLLGLPGAKERLTLWKADLEDKGSFDEVIEGSIYMFHLATPMDFESTDPENEVIKPTINGVLNVMKSCKKSKTVKRVIFTTSAGTVNVEEHLKPVYDETSWSDVEFCRRIKMTGWMYFVSKTLAEQAAWDFAKENNIHLISVIPTLVVGPFIMNSMPPSMITALALITGNKAHYSILKQIQLVHLDDLCNAHIFVATHPKAEGRYICSSEDPTIFQLANMIRDRHPEFDIPTKFEGIDEAIKPIHFSSKKLKDLGFQFKYTMEDMYDGAIQSCREKKLFPPELEKNKKQYDHQKEVLVKEKKISTAVPNAVLQEIEKNIN

SEQ ID NO: 428 - protein, 320 aa, Stylophorum diphyllum
MAEYCVTGGTGFIASYLVKALLEKGHRVRATVRDPENVEKVGFLWEFTGAKERLKLVKADLMMEGSFDDAVNGVDGVFHTASPVNVPYDNDVQATLIDPSIKGTMNVLKSCAKASSIKRVVLTSSCSAVRYRYDVQQVSPLNESHWSDPEYCKSYNLWYPYSKTLAEEHAWKWAKESGIDLVVVNPSFVVGPLIAPYPTSTLLMILGIIKGMRGEYPNFRLGFVHIDDVVAAHILAMEESKASGRLICSSSVAHFSEIIEMLKSKYPSYPFENKCCDRKGDDNPHSMDTSKIRQLGLPAFKTIPEMFEDCIKSFQEKGFL

SEQ ID NO: 429 - protein, 321 aa, Stylophorum diphyllum
MAKGTVCVTGASGFLASWLIKRLLLSGYHVVGTVRDPGNDTKLAHLWNLQGAKERLRLVKAELTEEGSFDDAIKGCEGVFHMASPVLGQPTDPQDILKPAIDGTLNVLRSCKKNPSLRRVVLTSSSSTIRVREKLDPKNPLDESSWSSVELCSKLKIWYVLSKTMAEKAAWEFCNENGINLVTVSPSFVVGPSLPPALCSTASDILGLLQGETERFYWHGRMGYVHIDDVALCHILVYEREEAEGRYLCSSTVVDNDELVSILSARYPTLPIPKRFEQHERPYYDFNTNKIKSLGFTFKSIPEMFDDCITSLVAQGHLSIP

SEQ ID NO: 430 - DNA, 993 bp, Nigella sativa
atgagtagcagtactactactgaaggtgcagggaagacagtgtgcgtaacaggtggttctggatacatagcttcatggcttatcaagcttctgcttcaacgtggttacactgtcaaagctactgttcgtgacccaaatgatcctagacagaccatgcatttacgtgaactttgtggagctggtgagcgacttagtttgttcaaggcagacttattgagtgaaggtgtttttgactccatagtcaatgattgcgacggtgttttccatacagcatctccctgctattttgaagccaaagatccacaggctgaaatagttgagccagcggtgaagggaacacttaatgttctcagatcttgcactaaatcaccctcagttaaaagggtgattgtgacatcctctattgctgcagttctgaacaatgggaagcttcgaactcctgatgttgttgttgatgagacatggttttctgatccagaagtctgtaaggaattgaagctttggtatccactctctaaaaccttagcggaagaatctgcttggaagtttgcaaaagatcatgggattgacatggtttccataaaccctgcaatggtgattggacctcttttgcagccaacacttaattcaagttcttcaatcattctgaatctgataaacggagcgaaaacatatacgaacgcagcttatggattggtagatgttagagatgttgcaaatgcacatattctcgcatttgaggttccttcagctactggaagaatttgtttagctgagaaagtttgtcacttttcagagatggtggagatcttacatgagctttacccagacatccaacttcctacaaaatgtgccaccgatgagccatttgtccaaccctatcagctttgtacagagaaggccaggagcttgggcattaattttactcccattggagtcagcctcaaggaaacggttgaaagcttgaaagcaaagaagtttgtcaacttgtga

SEQ ID NO: 431 - protein, 471 aa, Papaver somniferum; identical to SEQ ID NO: 6

SEQ ID NO: 432 - protein, 320 aa, Papaver somniferum; identical to SEQ ID NO: 12

SEQ ID NO: 433 - protein, 313 aa, Papaver somniferum; identical to SEQ ID NO: 16

SEQ ID NO: 434 - DNA, 1071 bp, Argemone mexicana
atgggtgtaaatgataaacaagatcaaaatcaagaggttgacattaaagatcaagctcatctctggaatataatttatgggtttgctgattcacttgttcttcgttgtgcagtagagattggaattgcagatattataaaaaacaataatgggtcaatctctgtttcagaacttgcatcaaaactcccaatttcaaatgtaaattctgataatttatatagaattctaagatacttagtacatatgagtatcttaaaagaagaaacatcatcagacattaatggtggaaacaagctttactcacttcaaccagttggtactttactcttaagagatgcagagagaagtatggtacctatgattttaggtatgactcaaaaggattttatgattccatggcattttatgaaagaaggattaggaaatggggaaacagcatttgagaaaggaatgggaatgacaatatgggaatatttagaaggtcatcctgatcagagtcaattatttaatgaaggaatggctggagaaacaagacttctaactaaatcattaattaatggttgtagagatatttttgaaggtttaaattctcttgttgatgttggtggaggaaatggaacaacaattagggctatttataatgcttttcctcatataaaatgtaaactttatgatctacctcatgttattgctaactctcttgatcaaccaaatattgaatgtattcctggtgatatgttcaagtttgttcctactgctcaagcaatcttactcaagttgatcttgcatgattggactgatgaagagtgtgttaacattctaaagaagtgtaaagaagcaataccaaaagaaacagggaaagtaatcatagtagatgtagcacttgaagaagaatcaaaacatgaacttacaaagacaagattgattcttgatattgatatgttggtaaacactggtggtagagaaagaactgcagatgattgggaaaatttgctgaaacgtgcaggttttagatctcataaaattagatccattgcagctattcagtctgtcattgaagcttatccatag

SEQ ID NO: 435 - DNA, 1074 bp, Argemone mexicana
atggaagtcaacaagattgatcaagaaaaccaatcaaaaatttggaaacaaatttatggttttgcagattcattagttcttaaatgtgcagttcaattagaaattgctgaaacaattcataatcatggaaaacccatgtctctatctgaattagcttcaaaattaccgattcaacccattaatttggatcgtttatacagagttatgcgttatttagttcatatgaagctcttcaacaaagaaattatcaccattaatggagatatcaataatacagaaacagtgattaaatactcattagctccacctgcaaaatatttaataagaggttgggaaaaatcaatggttgcttcaatattagcaattaatgataaagatttcttagcaccttggcatcatttaaaagaaggtttaactggtaattgtgatgcttttgagaaagcattaggtaaaagtatatgggtttttatgagtgaaaacccagaaaaaaataaactttttaatgaagcaatggcttgtgatactagattagttacttcagctttagttaatgaatgtaagaatattttttgtgatgatggaattaaaaccctagttgatgttggtggtggtactggtacagccatgaaagctatttctaaagcttttccaaatatcaattgtactatttatgatcttcctcatgttattgctgattctcctgagatcccaaatattactaaaattgctggagatatgttcaagtctattccttctgctgatgccatcttaatgaagtgcatccttcatgattgggatgatgaggaatgcattaaaattctaaagttatgtaaagaagcagtaccaagaaaaggaggaaaagttattatagttgatgtggtgttaaacatggatatgactcatccatattcaaagattagattgacattggatttagatatgatgcttaacactggaggaaaagaaagaacagaagaagaatggaagaaattatttgatgctgctggttttgctacttataaaattactcaaatttctgcagttcaatctgtaattgaagcttatccttattaa

SEQ ID NO: 436 - DNA, 1053 bp, Berberis thunbergii
atggagttgaatggaaaggatgagtctgtagacattaaagcacaagctcatctatggaagatcatatatggctttgctgattcccttgtccttcgatgtgctgtagagcttgggatagcggatatcatcaacgacaacaaccagcctatcacactccctgaccttgctgccaaactcccagtctccaatgtgaattttgatcacttgtatcgaattcttcggtacttagcccacatgaagctgatcaaacaagaggagaaacgaggtgttacactctactcacttgaaccaattggaacaatgttggtaaagaatgcaaagagaaacatggttccaattatccttggaatgacccaaaaggacttcatgacttcatggcatttcatgaaggatggtttgagcaacgacggtaccactgcctttgagaaggggatggggatgaccatatgggagtatcttgaaggtcacccagagcagagtcagttgttcaatgaagggatggctggtgaaactaggcttcttacttcttcactcattaatgggagtagagacttgtttaaaggtatcaattctcttgtggatgttggaggaggcaatgggactaccattaaggccatatctgatgcttttcctcatattaagtgcacactatatgacctccctcatgtcgtcgccaactcttatgatcttcccaatgttgaacgcattcctggggacatgtttcaatctgtgcccagtgcccaggctatcttgctcaagctaattttgcatgactggagtgatgaggactgcatcaagatcctaaagaaatgcaaggaagcagtgccaaaagagggagggaaagtgataatagtggatgtggcattggatgaggagtctgatcatgagcttaccagtacaagattgatccttgatatagacatgttggtgaacactggtggtaaagagaggtctaaggaagattgggacaagctcatcaaagctgcaggctttaaaggattcaatatcaggcacattgctgcagtacagtctgtgattgaagtcttcccatag

SEQ ID NO: 437 - DNA, 1062 bp, Berberis thunbergii
atggctgctaattctgaaatggtggaagaaaacatcatagctaaccaagctaagctctggaactccatctatggattttcagagacatttgtgttgagatgtgcagtagagcttgacattgctactatcattcacaaccatggaaagtccatgacactctctgagttagtttcacagctcacagtgaaacaaccggttaactcagatagtttgtcccgattgatgcgatacttggtatacatagacatcttcactgatacagtagatgtagacagagaaaccagatatggacttgcaccacttggtaaatttttggttaaagggtcggatcactgcgtggttgaggaaatgttggtggtcactgataaggagttcatggctccatggcaatgcatcaaggatggcatcacagatggcagcaagactgcttttgaaaaaacatttgggatgaatatatgggagtacatgggaaagcactcggaaaagaatactaccttcaatgaattcatggcaagtgactctagaatcatgtcatcagagttggtaaacaaatgcaaagataagttccaagggttaaattccttagtggatgttggcggtgggactggaactactgctaggagtattgccaaggcatttccaagcataaaatgcacagtttatgatctacccatcgttcttgccgattcccttgtttgccctgaaattactcaagtctcgggtgacatgtttaagtttgtaccttctgcagatgccgtcctgttgaagtacattcttcatgattggggtgataaagaatgtattgaaatcctaaagagatgcaaagatgcagtgcccaaagatgttggaaaggttatcatcatagacactgtactagatgtgaagtcagaccatccttacacaaagttaaaacttagtttggatctagacatgatgattaacacaggagggaaggagaggagtgaagaggaatggaagacactcatccaagctgctggatttaaaaactacaatataactcaattatctgctctaccttcagtcattgaggcttttccctag

SEQ ID NO: 438 - DNA, 1050 bp, Chordyalis celanthifolia
atgggtgtcaatgatatagctgaagttcaggatgttgacctcaaagctcaagctcatctatggaacataatctatggattcgccgattcgctcgtccttcgttgcgcagttgagctcggaatagcagacattatcaatagcaacaatgggccagtcacaatctctgaaatcgcatcgaaactcccggttgacaatgttaataccgataacttatatcgggttttacgttatttagtctacatgggtctcttgaaagagtcccaaaataagtgttactcattagaaccagttgctactttgctcttgaaagatgctcagagaagtatggttcctatcattctaggaatgactcaaaaggatttcatggttccttggtttttcatgaaagaaggattgggtagtgggagtagtactgcatttgagaaaggtatgggaatgactctttgggagtatttggaaggacacccagatcagagtcaattgtttaatgaaggaatggctggtgaaactagatttttgacttcttcgcttatcaatggttgtcgtgacactttcgaaggtttaacttctcttgttgatgttggaggaggaaatggtacaaccattaaaggtattcatgatgcatttccccatattaaatgctctgtctatgatcttcctcatgtcattgctaatgctcatcctcaccccaacatcgaacgaatccctggagacatgttcaagtctgttccaagtgcacaggcaattttactcaagctgatcttgcacgactggactgacgaagaaagtgtgaacattctaaagagatgcagagaagcagtacctaaagaaggaggaaaagtgattatcgttgatgtagcactggaggagggatctcaacatgagcttacgaagacgagattgatacttgatattgatatgttggtgaacacaggtggaagagaaaggagtgtggatgattgggacagaatgctcaaacttgcagggtttagtagtcacaagatcaggcacattgcagccattcaatctgtcattgaagccttcccatag

SEQ ID NO: 439 - DNA, 1044 bp, Chordyalis celanthifolia
atggaagtgatcaagaagagtgatcaagcagatcaagccaaactctggaagttcatctatggatttgccgattcactagttcttaaatgcgcggtcgagctagaaatagccgatacgattcataagcacggggaaccgatgacgctttccgaattagctactaaacttcctaaacaacccatcgatacggaccgtctatatcgaataatgaggtacttggttcaaatgaagttgtttacaaaagagacttctcaatccggggaagtcaaatatgggcttttacccccagcaaaatttgtggtaagaggatggcagaattccatggttggttcattgctagcaatcaatgataaggatttcattgcaccttggcattatctcaaggatggtttgggtggcgaatgtgatgctttcgagaaggcattaggaaagaaaatttgggattatatgtccgaaaaccccgaaaagaatcaacttttcaatgaggctatggcttgtgatactaggcatatccttatttcggcgttgattaaagattgtaaggatgttttcaaaggaattaagacacttgttgatgttggtggtggcaccggaaccgcggtgaaagcgatttctgatgcttttccggatataaaatgcgcggtttatgatcttcctcatgtgattgcggattctcctgttgctcctaatatcgatcgaatcgaaggcgatatgttcaagtccatcccaaatgcagatgccatctttatgaagtgcatcctccatgattggaacgacgacgaatgcattcaaatacttaagcaatgcaaaaaagcgctacaagacggaggtaaagtaatcatcgtagacgtggtgttgaatgtggattcgaaacatccttacacaaaaatgagattgactttggatttggacatgatgctcaacactggagggaaagagagaacagaggaggaatggaaagaactgtttgaagctgcaggtttcagtggatacaaaatcattcaaatatcagctctacaatccgtgattgaggcttatccttaa

SEQ ID NO: 440 - DNA, 1059 bp, Chelidonium majus
atgggtgtgaatgatatggcagtatctcaagaggttgacatcaaagctcaagctcatctctggaacatcatctatggctttgctgattctctagtcctccgttgtgcagtagagattggaattgcagatatcatcaagaacaacaatgggtcaatctctgtttctgaactctcatcaaagctcccaatctcaaacgtcaattctgataacctctaccgtgtcctaagatacttggtacacatgggtatcttgaaagaagattcagacattaatggtgtcaagctttactcactccaaccagtagctactctgcttttaagagatgcagagaggagcatggtacccatcattttagggatgacccaaaaggatttcatggttccatggcattttatgaaagaagggttaggagatggaagcactgcatttgagaaagggatggggatgaccatttggcagtacttggaaggtcatccagaacagagccagttgttcaatgaagggatggctggggaaactaggttactgactaaatcacttattgagggttgtagagatacatttgaaggtttgacatctcttgttgatgttggaggaggaaatggcacaacaattaaaggaatttatgatgcatttccacagatcaaatgctctgtttatgatcttcctcatgttattgctagctctcctgagcacccaaatattgaaagaattcctggtgatatgttcaaatctgttcctagtgctcaagctatcttactcaagttgatcttgcacgattggactgatgacgagtgtgtcaacattctaacaaagtgtagggaagcagtaccaaaagagacagggagagtgatcatagtagatgttgcacttgaagaagagtcccaacatgaactcacaaagacaagattgatactagatattgatatgttggtgaacactggtggtagagagagaactgaagatgattgggaaaagttgctcaaacgtgccggctttagaggtcataagatcaggcacattgcagctattcaatctgttattgaagccttcccatag

SEQ ID NO: 441 - DNA, 1071 bp, Chelidonium majus
atgggaagtagcagtatagatgtgaaaccagctgaaacacaagaagttagcatcaaagatcaagctcaattatggaatatgatctacggttttgctgattctcttgttgttcgttgcgcagtagagcttggcattccagatattatcaaaaacaataacgggccaatcacacttgcacaactttcatcaaaactcccaattccgaatgtcaactcggatcacttgtacagaattgtaagatatttaataaacctgaatatcttacaacaagaaatttgtcgtaatgttaaggtctactcacttaaaccagttggtactttacttttaagagatgcagaaagaagtatggtgccaatattattaggcaatacacagaaagatttcttggttccatggcatttcgtgaaagaaggtttagtaaatggaagtacaacagcatttgagaaaggaatgggtatggatatatggaagtatttagaaggtaatccagatcaaagtcagttgtttaacgaaggaatggctggagaaacaagtcttttaactaaaactctaatcgaagattgcagagatactttccaaaatttggattctctagtcgatattggtggaggaaatggtacaacaattaaggcaatctatgaagcttttcctcatatcaaatgtacgctttatgatctaccacatgttgttgccaactctcatgatctccctaaaatcgaaaaagttcccggtgatatgttcaagtctgttcccagtgctcaggctatcttactcaagttgattttgcatgactggactgatgaagagtgtgtcaacatcctaaagaagtgcaaagaagcaataccgaaagagacagggaaagtgattatagtggatgtagcacttgaagaagaatccaaccatgaacttacaaagacaagattgattcttgatattgacatgttggtaaatactggtggtagagagagaactgcagatgattgggaaaatttgctcaaacgtgcaggctttcggtctcataggataagacccattcgcgcaattcagtctgtcatcgaagccttcccttag

SEQ ID NO: 442 - DNA, 1110 bp, Cissampelos mucronata
atgacagtgctggaggggctaaccatctctgtcctctgcactcccattacttcatttggtaagaataccatggaagaagccatggatgtccatgagcaagcacacctgtggaagctcatctacggcttcgtcgacaccttagtagtaaggtcggcggtggagctcggaatcttcgacatcatcaacaacaatttgaagcccatgacagtgctggacttggcctcaaagctccccatctccaacccctgttcggatcggttgtatcgaattcttcgatacctagttcatgtccgccttctcaaggtgaccgatatcgatggcctcaagcgctactcgatccaacccgtcgcgaggttcctactaagggactacgacaagagcatggcgcctatcattctgggcatgactaagaaggagttcatgtcttcatggcaccacattaaggatggattgagcgacgacgggagcaccgccttcgacaaggccatggggatgagcttcttcgagtacttggaggagaaccccagccagagcaagctcttcaatgaggccatggcgggggagactaggcttctcactgcttccctcatcaatgactgcaaagacatctttcaaggaattgagtccctggttgatatagggggaggaaatggcaccaccattaaggccatttccgatgcgtttccgcacatcagttgcgccctcttcgacctccctcatgtcgtcgctgactccaacgatgatcacccgaatattaaacgcgtcgctggagacatgttcgagtccatccctacctcccaagccatcttgctcaagttgattttgcacgattggagcgacgaagattgcgttcggattctaaagcgatgcagggaggcggtgccgaaggaaggggggaaggtgatcatagtggatgtggcattagaagaggagtccaagcatgagctgaacaatccaaggttggttttagacattgatatgttggtgaacactggagggaaagagaggagcagagaggattgggagaagctcaccaaactagcagggtttggagggtacaagattaggcacattgctgctatacaatcagtcattgaaatcactccttaa

SEQ ID NO: 443 - DNA, 1032 bp, Cissampelos mucronata
atggaagaggaaatgaaagcacaagcccaggtgtggcgctacgtgtacggcttcgccgactccctcaccctcaagtgcgccatccagctggacatccccgacatcctccaccggcacggccgccccctctccctctccgccctcgcctcccgcctccccctccccaccgtcaaccccgaccgcctccaccgcctcatgcgctacctcgtccacatgggcctcttcgacctggtcccttcccccgacgagcccgcctacgcctccaacccttcctccgccctcctcgtcaagggccagcccaagagcctcgcctccttcgccctcctccagtactacgagatggacgcctggcaccacctcagcgccgccgtcgagggctccgtcaccccctgggagaggtgccacggggtcgactacagggagtacttcgccaaggaccccgtggccaaccagctcctcagcgacgccatgaccagccataccagcatggtcacggaggcgctggtggagggctgcaggaaggccggggcgctggacggggtgcgctcgtttgtggacgtgggcgggagcacgggggtggccgcgagggccgtggcgaaggccttcccggggatcaagtgctcggtgtttgatctgcctcatgtgatcgccaccgcgccggagtgtcccgaggtggagaggattgaaggggacatgttcgcgtcggtgccggagaccgatgtggtcttcatgaagtcggtgttgcatgattggggagatgaggattgcgtgaagatactaaagaaatgcaaggaagcgatagcggggaaggagggagggaaagtggtgatattagacatagtgttggatgtagaatcgagttacgagttcaagggggcgaggttggggatggagatggacatgttggtgacagtgggagggaaggagaggagcgaggcggaatggcagaagttgatcaaggatgcaggttttagccggtacaagatcacacccattgttgccattgaatccattattgaagtcttcccttag

SEQ ID NO: 444 - DNA, 1029 bp, Cocculus trilobus
agaccaagcagcccaagcccagctgtggaagttcatctatggctttgcagagtcactagtcatcaaaagtgcaattcagcttgacatcccagacatcattgacaaccatggcaagcccatcaccatctccgagcttgcttctcggattccctcgcaaggccccgttgaccacgaccgcttgtatcgaatcatgcggtacttggtgcacatgaagctcttcacaaaagagtccatcgacggtgaagatcaatatgggcttgcaccaccagcgaaatacctagtgaaggggtgggagaaaagcatagtgccttcaattctatgcattactgataaggaattcatgtcaccatggtaccatctcaaggaaggtttgtctaatggcgacaaccagaccgccttcgagaaggctttgggggtaaacatatgggattatatgtctaagaacccaaagaagaacaacatcttcaatgaagccatggcttgtgatactaggcttctcatgtctgcattggtgagtgaatgtaaggacatgtttcaagggattaagtcattggtggatatcggcggtggcaccggaaccgctgttaggtacattgccaaggccttccctcatataaactgcactgtttatgatctccctcatgttgctgctgattctcctacttatcccgaagtgaatcgcatcgaaggtgacatgtttaagtacattcctagtgctgatgccatcctaatgaagtgcattcttcatgattgggccgacgaggaatgcattcagattctgaagaagtgcaaagaagcattgccaagtactgggggaaaggtgatccttgtcgatatcgtgctaaacgcatattcggagcatccatactcaaagatgaggatggtgatggacttggatatgatgctgaactgtggaggraaagagagaacagaggaggagtggaagaagctcatctatgcagctggttttagtaggtacaatataaggcaagtcaatgccatacagtctgtcattgaggtttacccttg

SEQ ID NO: 445 - DNA, 1032 bp, Cocculus trilobus
atggaagaagaaatgaaagctcaagcccaagtgtggagatacgtgtacggtttcgcggagtcactgactctcaaatgcgcgattcaactcaacatcccggacatcctccatcaacacggccgacccatgactctctccgagttagcctctcatctccctctccccaccgtaaaccaagaccgattattccgagtcatgcgttatctcgtccatatgggcctattcgacctagtcgactcgcccgattcaaagaaatactccctcaactcggcctcaaagctcctcatcaaaggccaagacaagagtttggcatccttcgctctcctacagtactacgagatggacgcctggcaccacctcagcgccgccgtggagggcggagcgacgccgtgggagaagtgccacggcgtggattacagagagtacttttccaaggactcggtggcgaatcagttgttgagtgatgccatgacgagtcatactagtatggtgaccgaggcgttggtggagggctgtaagaaggctaatgtgctcgacggagtccgatcgtttgtcgatgtcggtgggagcaccggtgttgcggctcgagccgtggccaaggcctttccgaacgtcaaatgctcggtgtttgatttgcctcatgtgatcgccactgcgccggagtgccccgaggtgacgaggatcgaaggggacatgtttgtctccatccctgaaacggatgttgtcttcatgaaatcggtgctgcatgattggggagatgaggattgtgtgaagatattgaagaaatgcaaggaagcaatagcagggaaggatggaggaaaggtagtgatattggacatagtattggatgctgagtcgagttatgagttcaagggggcgaggttggggatggagatggacatgttggtgactgtgggagggaaggagagaggtgaagaggaatggcagaaattgttcaaagctgcagggtacagtcgttacaagatcactcccatcgtggccattgaatctgtcattgaagtgttcccttag

SEQ ID NO: 446 - DNA, 1062 bp, Eschscholzia californica
atgggtttagaatttaatgaagaagttgatatcaaagctcaagctcatctatggaacataatttatggatttgctgattcattagtccttcgttctgcagttgagttaggaattgcagatatcatcaagaacaacaatggttcaatcactgtatcagaacttgcatcaaaactccccatctcaaatgtcaattctgataacttatatcgagttttaaggtacttagtacacatgggtatcttaaaagaaaccaaatccaccattaatggaggagaaattaagaagctttactcacttgaaccagttggtagtttactagttaaagatgcagaaagaaatatggtacccattgttttagggatgacccaacaagattttatgattccatggcattatattaaggaaggattgggtgaaggaagtactgcttttgagaaaggaatgggtatgacactttgggaatatttagaaggtcatcctgaacaaggtcatttgtttaatgttggaatggaaggtgaaactagacttttgactaaaaccctaattgaaagttgtaaagatacttttgaaggtttgagttctttggttgatgttggtggtggaaatggtacaacaattaaggcaatttctgaagcatttcctcatataaaatgtagtctttatgatcttcctcatgttgttgctgattctcatgatcttcctaatattgaaaagatccctggtgatatattcaagtttatacctaatgctcaagctatcttactcaagttgatcttgcatgattggagtgatgaagactctgtcaagattctaaagaagtgcagagaagcagtaccacaagatacaggaagggtgatcatagtagatgtagccctagaagaggaatcagaacatccactaacaaaaacaagattggttcttgatgttgatatgttagttaatactggtggaagggagagaagtgaagatgattgggcaaaattactcaaacttgcaggttttcgaactcacaagataaggcatattgctgctgttcaatctgttattgaagctttcccttag

SEQ ID NO: 447 - DNA, 990 bp, Eschscholzia californica
atggaaatggaaggagcagacaagattgatcaagcaacccaagccaaaatttggaaacacatctatggttttgcagaatccctagttataaaatcagcagttgaacttgaaattgctgatacaattcacaaccatggaaaacccatgactctatccgagttagcttcaaaattacctgttcaacccgttgacttagaccgtctttaccgagtcatgcgttatttagttcatatgaagcttttcaagaaacaagaagatgaagaagaatcaattaagtactctttattaccaccagccaaatttctgattaagggttgggagaaatcaatggtgagtgcaattcttttaatcaatgataaagatttcatgtctccatggcatcatttgaaagaaggattagtgaataattctaatgcttttgataaagcattagggaaaagtatatgggattatatgagtgctaatcctgataaaaacaaggtttttaatgaaggtatggcttgtgattctagattagtatcatcagctttagttaatgagtgtggaaatattttccaaggaattcaaactcttgttgatgttggtggtggaactggaactgctgtcaaagctgtttcaaaggctttcccacatattaagtgtagtatttatgatctcccccatgtgatttctgattcccctgatattcctaatattgtcaaaattgagggagatatgttcaaatcaattccaagtgctgatgccattctcatgaagtgcatccttcacgattggaacgatgaggaatgcattgaaattctaaaaaaatgcaaagaagctgtgccgaaggaagggggtaaagttattatcgtcgatatagttctagacatggaatcaaaacatccttattccaaggttagactaactctagatttggatatgatgctcaatactgaaggaaaagagagaacagaagaagaatggaagaaattgattgatggtgctggtttt

SEQ ID NO: 448 - DNA, 1062 bp, Glaucium flavum
atgggtgtcagtgataacaaaccagaatctcaagaggtggacatcaaagctcaagctcatctctggaacatcatttacggatttgctgattctctagttcttcgttgtgcagtagaaattggaattgcagatatcatcaagagcaacaacgggtcaatctctgttacagagctagcatcaaagctcccaatcacaaatgtcaattctgataacctctaccgtgttctaaggtacttggtacacatgggtatcttgaaagaagtttcagacagtaatgaagtcaagctttactcacttcaaccagtagctactctgctcttaagagatgcagagagaagtatggtgcccatcattttgggaatgacccagaaggatttcatgattccatggcatttcatgaaagaaggattgggaaatgatactactgcatttgagaaagggatggggatgacaatttggcagtacttggaagggcatccagaacagagcaatttgtttaatgaaggaatggctggtgaaactaggttactaactaaatcacttattgatggttgcagagatacttttgaaggtttaacttcactttgtgatgttggaggaggaaatggaacaactattaagggaatttatgatgcgtttcctcaaataaaatgctctgtttatgatcttcctcatgttattgctagctctcctgaacacccaaatattgaaagaattcctggtgatatgttcaagtctgttcctagtgcccaagcaatcttactcaagttgatcttgcacgattggaccgatgaagagtgtgtcaacattctaatcaagtgtagagaagctgtaccaaaagacacaggaaaagtgatcatagtggatgtagcactagaagaagagtcccaacatgaacttacaaagactagattgatacttgatattgatatgttggtgaacactggtggtagagagagatctgaagatgattgggaaaagttgctcaaacgtgcaggctttagaggtcacaagatcaggcacattgcagctattcaatcagtcatcgaagccttcccatag

SEQ ID NO: 449 - DNA, 1062 bp, Glaucium flavum; identical to SEQ ID NO: 448

SEQ ID NO: 450 - DNA, 1062 bp, Hydrastis canadensis
atggatgccaatggaaataaggatcatgaatcatcagacatcaaatctcaagctcatctttggaagatcatatatggttttgctgattcccttgtccttcgatgtgccgtcgaattagaaatcttcgatatcatcgacaataacaaccagcccatcacagtctcggagctggcctctaagctccctattgccgatgtcaattccgataatctatatcggattttacgttacttggttcaaatgaaaatattgaaattaaacaaggttgttgatgatggtgtcaacaagtattcacttcaacccattgctgctttgctccttaggaattctaagaggaatatggttccaatcatccttggaatgactcaaaaagattttatgacttcttggcattctatgaaagatggtttaagtaacaatggtactgcttttgagaaaggaatggggatgactatatgggagtatttagaaggtcatcctgaacaaagtcaattgttcaatgaaggcatggctggtgaaacaaggctcttgacatcttcactcatatctgggagtaaagatatgtttcaaagtattcattcacttgtagatgttggtggtggtaatggtactactattaaggccatttctgatgcttttcctcatatcaagtgcaccctttttgacctccctcatgtcattgctaatgcctatgatcaccccaatatcgaacgcatcccgggtgacatgtttaaatccatgcctagtgcccaagccattttactcaagctaattttgcacgattggagtgacgaagattgtattaagattctaaagagctgcaaggaagcagtgccaaaagatggagggaaggtaattatagtagatgtagcattggatgaggaatcagaccatgagcttaccagcacaagattgatccttgatattgatatgttggtgaacactggtggtagagagaggagtaaagaggattgggaaaagcttgtcaaatgtgctgggttcaaaggttgcaaaatcaggcacatagctgctgtacaatcagtgattgaggtctttccttag

SEQ ID NO: 451 - DNA, 2142 bp, Hydrastis canadensis
atggagatcaaaatggagggggttgaagggcatgagttacttgaagctcaagctcatatatggaaccatacattcaacttcataacctctatgacactcaaatgtgcagttcaattaggcataccagatattatctacaaccatggccaacctatcactctctccgagttggtgaaggcactttcaatccaccagatgaaatcagattacttgtaccgcctaatgcgcatattggttcactctgaattctttgccatacaaaaaattcatgaagatcaagaaggatatgtgctgacaccatcatccaagtatctcttgaagaatcaactgacaaacttgtcgccgtacatattaatggtgctagatcctgtcttagtaacaccttgtcatttcatgagtgcctggttccaagggaatgaatctacaccatttgaggtcgctcatgggatgagcttttgggaatactgtggccaacaccctgatatcagaaagtacttcaataaagcaatggctagtgatgcagaattggtgatgaccgtggcttctaaagagtgtaaaacgatgttcgaagggttcaaatcattggttgatgtagggggtgggacaggaacgatggccaaggctatttccaagtcattcccacacttgaaatgtactgtttttgatcttccctatatagtttcaaacttgcaaggaagcgaaaacatagaattcgtcggtggagacatgtttgagtctgtccctcctggagatatattcctactcaagttgattttgcacgattggaaggacgaagaatgtgtgaatatactaaagcgatgtagggaagcgatttcattagagaacaaaggaggaaaagtgattataatagacatgattgtggatgacaacagaggaaaatatgaatcaactgaagcacaactctgctttgacatgttgctgatggttttggtcactggaaaagagagaactgagagtgaatgggagaagctcttcctagaggctggttttactagttacaagataactcctgctttgggtctaaggtccttcattgaagtattcctgtagatggagatcaaaatggagggggttgaagggcatgagttacttgaagctcaagctcatatatggaaccatacattcaacttcataacctctatgacactcaaatgtgcagttcaattaggcataccagatattatctacaaccatggccaacctatcactctctccgagttggtgaaggcactttcaatccaccagatgaaatcagattacttgtaccgcctaatgcgcatattggttcactctgaattctttgccatacaaaaaattcatgaagatcaagaaggatatgtgctgacaccatcatccaagtatctcttgaagaatcaactgacaaacttgtcgccgtacatattaatggtgctagatcctgtcttagtaacaccttgtcatttcatgagtgcctggttccaagggaatgaatctacaccatttgaggtcgctcatgggatgagcttttgggaatactgtggccaacaccctgatatcagaaagtacttcaataaagcaatggctagtgatgcagaattggtgatgaccgtggcttctaaagagtgtaaaacgatgttcgaagggttcaaatcattggttgatgtagggggtgggacaggaacgatggccaaggctatttccaagtcattcccacacttgaaatgtactgtttttgatcttccctatatagtttcaaacttgcaaggaagcgaaaacatagaattcgtcggtggagacatgtttgagtctgtccctcctggagatatattcctactcaagttgattttgcacgattggaaggacgaagaatgtgtgaatatactaaagcgatgtagggaagcgatttcattagagaacaaaggaggaaaagtgattataatagacatgattgtggatgacaacagaggaaaatatgaatcaactgaagcacaactctgctttgacatgttgctgatggttttggtcactggaaaagagagaactgagagtgaatgggagaagctcttcctagaggctggttttactagttacaagataactcctgctttgggtctaaggtccttcattgaagtattcctgtag

SEQ ID NO: 452 - DNA, 1056 bp, Jeffersonia diphylla
atggaagtcaatggaaagactaatgaagctgtagacatcaaagctcaagctcatctatggaaaatcatctacggctttgccgattccctggtcctgcgatgcgctgtggagcttgggatagcagacatcattgataacaacaaccagcccatcacactctccgaccttgcatcaaagctcccacttcccagtgtcaatattgattacttgtatcgaatcatgcgttacttggttcacatgaaactattcaaagttgaggaaaatatcaatggtgtcaagcaatactcgctccaacccactggcactttgctcctaaggactgcagagaggaacatggttccaatggtccttgggatgactcaaaaggattttgtcaccccttggcacttcatgaaggatggtctaagcgacgatggcacagcctttgagaagggaatggggatgaccatatgggagtacctagaaggacatccggatcaaagccaactcttcaatgaaggcatggctggtgaaactaggcttctaacgtcgtctcttatatctggatgcggagacctttttaaaggtattacatctcttgtggatgttggaggaggaaatggtactactcttaaagggatatcagatgcatttcctcatatcaagtgcacactctttgatcttccttatgttattgctaactcttatgatcatccaaatatcgagcgcattgctggggatatgttccagtcagtaccaagtgcccaggccatcttacttaagctaattttgcacgactggagcgatgaggactgtattaagattctgaagaaatgcaaggaagcagtgccaaaagagggaggtaaagttataatagtcgacgtggcattggacgaggagtccgatcatgagcttactagcacgagattgatacttgatattgatatgttggtgaacaccggtggcaaagagaggactaaggaggactggaataagctcgttaaagctgcaggttttcgaggtttcaacatcaagcacattgcagctgttcagtcagtaattgaggtctttccataa

SEQ ID NO: 453 - DNA, 1056 bp, Jeffersonia diphylla
atggaagctaaaactgggtttgagatatcatcccaagcaaacctatggaacttcatctacggattctcaaactcactagtcctgagatgtgcagtagaactggatatagccaacatcattcacaaccatggaatgcctattacactatccgaattggagttactgcttccggtgcagcctgttaatacggccagcttgtaccgagttatgcgttacttggcacacatcaagatattcaccaaaacattggacgtagatggggagactagatacggacttacaccgtcggctaagttccttgttaaaggctgggatcaatgcacggtgggtgcaattttgggtatcactgataaggatttcatggccccatggcattacatcaaagatgggcttacaggtgacagtaagaagaccgctttcgagaaggcactaggaatggatatatggaaatacatgggggatcacccagaaaagaacaagctgtttaacgcagcaatggcatgcgattcgaggcttgctatgtcggcattgataaatgaatgcaaagataagttccaagagataacatccctggtggatgtaggtggaggcactggaactgctgccagaaacattgctcaggcttttccccatattaagtgcactgtctatgatctacctcatgtcattgctgactcccctgtctaccctgaacttaattctgttgccggtgacatgtttaagtgcgtcccaaatgccgacgccatcttcatgaagtgcatcctccatgattgggatgacaaggaatgtattgaaattttaaagcaatgtaaagaagcagttcccaaacaaggcgggaaagtcattatcgtcgacattgtactaaatatgaagtcagaccatccttacacaaaattgagactgactttagatttggacatgatgctaaacacgggtggaggcaaggagaggacagaggaggagtggaaaaaactattccaggctgcaggttttagaggatacaacatcactcaaatatctgcattgcaatctgtgatcgaggcttttccttattaa

SEQ ID NO: 454 - DNA, 1053 bp, Mahonia aquifolium
atggagttgaatgggaaggatgagtctgtagacatcaaagcacaagctcatctatggaagatcatatatggctccgccgattcccttgtcctccgatgtgcagtagagcttgggatagcagacatcatcaatgacaacaaccaacccatcacactccctgaccttgcatccaaactcccactctccaatgtgaatattgatcacttgtaccgaattcttcggttcttagcccacatgaagttgatcaaacaagaggagaaacaaggcgttacgctttactcacttgaaccaattggaacattgttggtaaggaatgcaaagagaaacatggttccaataatccttggaatgacccaaaaggacttcatgacttcatggcatttcatgaaggatggtttgagcaacgacgggacaaccgcctttgagaaggggatggggatgactatatgggagtatcttgaaaggcacccagagcagagccaattgttcaatgaagggatggctggtgaaactaggcttcttacctcttcactcatcaatgggtgtagagacatgtttaaaggtattaattctcttgtggatgttggaggaggaaatgggactaccattaaggccatatctgatgcttttcctcatattaagtgcacactatatgacctttctcatgtcgtggccaactcttatgatcttcctaatgtcgaacgcattcctggggacatgtttcaatctgtgcctagtgcccaggctatcttgctcaagctgattttgcatgactggagcgatgaggactgcatcaagatcctaaaaaaatgcaaggaagcagtgccaaaagagggagggaaagtgataatagtggatgtggcattggatgagacgtcagatcacgagcttaccggcacaagattgatccttgatatagacatgttggtgaacactggtggtaaagagagaagcaaggaagattgggacaaactcgtcaaagctgcaggttttaaaggcttcaacatcaggcacattgcagcagttcagtctgtgattgaagtcttcccttag

SEQ ID NO: 455 - DNA, 1050 bp, Mahonia aquifolium
atgggggaagaaaacatagccaaccaagctaaattatggaatatcatctatggctttgcagactcacttgtgctaagatgtgcagtagagctcgatattgctaatatcattcacaaccatggaaagtccatgacactctctgaactggcttcagtgcttccggtgaaacaacctgttaattcggatagcttataccgagtaatgcgttacttggcacacttaagggtcttcactaagacattggacgcagatggagaaaccagatatgggctcgcaccaccggcaaattttttggttagagggaatgataattgcatggttggctcactgatggggcttactgataaggaattcatggctccgtggcactacatcaaagatggtctgtcaggtgatgatggtaagactgcttttgaaaaagcattaggaatggatatatgggaatacatgggagagaacccagagaagaacaagttgttcaatgaagcaatggcatgtgacacgagactcgtattgtctgccttgatcaacgaatgcaaggacaaattccaagggttaaattctctggttgatgttggtggtggcactggaactgctgcccggaaccttgccaaggcattcccacatttgaagtgcacggcttatgatctacctcatgtcattgctgactcccctgtttaccctgaaatcactcaagtcccaggcgacatgtttaaggtcataccatatgctgatgccatcctgatgaagtgtatccttcatgactggggtgataaagagtgcattcaaatcgtaaagaaatgcaaagaagcactgcccaaagaaggtggaaaggttattatcgtcgacattgtactagatgtgaaatcagaacatccttacacaaagttgagacttactttggatgtagacatgatgctcaacactggtggagggaaagagaggactgaagaggagtggaagaaactcatccaagctgctggtttcaaaagctataacatcactcaaatatctgctctacaatcggtgattgaggcgtttccttattaa

SEQ ID NO: 456 - DNA, 1068 bp, Menispermum canadense
atgatcttggacaaccatgacaaagcagaagaagctttagtagtggatgtccatgaccaagcacacctatggaagctcatctatggctttgtggacaccttagttgttagatcagcagtagagcttggaatcatggacatcatctacaacaacaagaagcccatctcgctcttcgatctcgcctcgaagctccctgtctccaacacctgtccggaccgattgtaccgcatacttcggtacttggttcacgttcgccttctcagagtggcagaggtcgacggcttgaaaaagtacttgctcgctcctgctgcgaaattgctacttaggaacactgagaagagcatggtgcccatcattctaggcatgacccaaaaggattttgtggtgccatggcatcacataaacgatggtttggggagtgagggtgccaccgccttcgataagtccatgggaatgtccttctttgagtacttagaagagaatcctagccagagcaagctcttcaatgaagccatggctggtgagactaggctgttaacagcttctcttatcaatggttgcaaagacttgtttcaaggtattgagtctttggtggatgttggaggagggaatggcacaaccattaaggccatatctgattcttttcctcatatcaagtgtaccctcttcgacctaccgtacgttgttgcagattctcacgacgaccctaatatcaagcgcgtccatggtgacatgttcaagtccatccctagttcccaagccatcttgctcaagttgattttgcatgattggagtgacgaagattgtgtgaagattctaaagcgatgcaaggaagctgtgcctaaggaaggagggaaggtgataatagtagatgtagcactggatgaggagtctcagcatgagttgagtagcacaagattgatacttgacatagatatgttggtcaacactggaggcaaggagaggagcaaagaggactgggagaagcttatcaaatgtgcaggatttggagggtacaaaattaggcacattgctgctattcagtcagtcatagaggtcttcccatag

SEQ ID NO: 457 - DNA, 1050 bp, Menispermum canadense
atggacaccaccattaatggaagcttattagaagctgatcacaatctccaagtcaaagctcaggctcatgtatggaacaccatctacagattctcagattctctcatcctccgcgccgtcatcgatctcggcattctcgacatcatcaacagcaacaacaacagcatttcgctctctgagctcgcctcgaagctccctctccaccacgtccaccacgaccacatcagccgcatcctccgccacctgacccacatgaaaatcttacgagtggtcaccgctgacgacgacggagatgataacatgatcaccaagtactcacttgagcctctagtggcggcgctgctgcttaagagctcggagaagagcttggcatataatgtactaggcatgattcaaaaggagtttgttctcccatggcactacattaaggattgtttagtgggctgtgatgagagtacaatatttactactccttttgagaaggccatgggagtgacgttttgggagtacttggagggccatttggaggatagcaagaactttaatgagtcaatggcgagtgagactcggcttctcacggcttcgctgatcgacggctgccgggatgtttttgagagtgttgggtcaattgttgatgttggaggagggaatgggacgactttgaaggcgatttccaatgagtttccgcatatcaagtgtactctgtttgatctcccttacgtggtggctaatgcttgtgattgtccggggattgagtgtgtctccggcgacatgttcaaagccatacccagtgctcaggccatcttattgaagttgatattgcacgactggggggacgaggactgtgtgaagattctaaagagatgcaaagaagcagtgcctagcgatgtgggcaaagtgatcatagttgatgtagcattagaagaggactttgaagacgagctcactggagcaagattagctctagacatggacatgttagtgaccacaggaggcaaagagaggaccaaagaagactgggagaagcttgtgaagcgtgcagggtttcgt

SEQ ID NO: 458 - DNA, 1056 bp, Nandina domestica
atggcaatgaacggaaaggctaatgaatttgaagacatcaaagctcaagctcatctatggaaaatcatttacggtttcgcagactccctagtccttcggtgtgccgttgagcttggcattgcagacatcattagcaacaacaacaagcccatctcactctcctgcctagcatcaaagcttccacttccgcatgtcaacctcgatcatttgtaccggataatgcggtacttagttcacatgaaactactaaaactagtagtgaatgaaaacggtgaaaaactatacgcacttgaaccaatttcaacattgttgttgaaggatgcaaagaggaacatggttccaatggttcttggaatgactcagaaagattttgtgaccccatggcattacatgaaggatggtttgagcgacgatggtacggctttcgagaaaggtatggggatgaccatatgggagtatttacaaggacatcctgatcaaagccaattgttcaatgaaggaatggcaggggaaactaggctgctaacttcctcactcatatctggatgtggagacttatttaaaagtcttacatctcttgtggatgttggtggaggaaatggtactaccattaaagcaatttcagatgcttttcctcacattaagtgcacattatttgatctaccttatgtcattgccaactcttatgatcatcctgatatcgaacgcatttctggggatatgttcaaatctgttcctagtgctcaagccatcttactcaagctaattttgcatgactggagtgatgaagactgcattaggattttgaagcaatgcaaggaagcagtgccaaaagagggaggtaaagttataatagtggatgtggcattggatgaagaatctgatcatgagcttactagcactagattgatacttgatattgatatgttggtgaacactggtggtaaagagaggactaaggaggattgggataagcttgttaaagctgcaggttttcgaggtttcaacatcaggcacatcgcagccatccagtccgtgattgaggtatttccatag

SEQ ID NO: 459 - DNA, 1053 bp, Nandina domestica
atggaagtaatgaaggagcaagatgtatcagctcaagccaagatgtggaactacatttatggattttcagaaacactagttctaagatgcgcggttgagcttgacattgccaatatcattcacaatcatggaaagcctataactcttccagagttagcatcaaaacttccaaggcagcctgtcaattctgatagtttgtatcgagtgatgcgtcatttggcacacatgaagcttttcactaaaacaaaggtggacggagataccaaatatgagcttgcaccatctgctaagtttcttgttaaaggggctgataagtgtatggttggtgcactattggcaatcactgataaggatttcatggcaccatggcattacatcaaggatgggctaacaggtgatagcaagagcactgctttcgacaaggcattgggaatggatatatggacatatatgggaaagcatccagagaaaaaccagttgtttaatgaagcaatggcctgcgacacaaggcttgctatgtctgcgttggtaaatgaatgcaaagacaagtttaatgggataaaatccttggttgatgttggtggaggaactggaactgcagtgaggaacattgctaaggcatttccccacattaagtgtactgtttacgatcttcctcatgtcatcgctgactcccttgcttatcctgaaattaatcgcattgcaggtgacatgtttaagtccgtacctaaagcggatgccatactaatgaagtgcatacttcatgattgggctgacgaggagtgcattgaaattctaaagaaatgcaaagaagcagtgcctgaagatggggggaaagttataatcattgacattgtactgaatgtggaatcggatcatccttacacaaagatgagactaactttggatttagatatgatgctcaacactgggggaggcaaggagaggactgaagaggagtggaagaaactcatccaggctgcaggtttcagaagctacaacatcacccagatatctgccgtacaatctgtaattgaggcttttccttattaa

SEQ ID NO: 460 - DNA, 1050 bp, Nigella sativa
atggctttctatgcaaatgatgaagctctagacgtcgaagctcaagctcatgtatggaaaatcatctatggctttgctgattccctggtcctccgatgtgcagttgaactcgagatattcgacatcattggcaacaacaactccatccaactctccgagttggcctcgaagcttccagttgcaaatgtcgtcccggatcatttgtacaggctgcttcgttacttaatcaagatggaactactaagactggaaacctcaaacaagggtgtaaaagaatacacactccaacccactgcacggttgcttcttaggaatgaaaagaggagcatggttccaatgatacttggcaacacacagaaggatttcatgactccttggcactcaatgaaagatggtcttggccacagtggtactgcttttgagaagtccaagggaatgactatatgggagtatttggaaacacatccagatcaaagccaactttttaacaaaggtatggctgctcaaacgaggcttcttacttcttcactcatatctgtaaacaaagacatctttcaaagcatcaactcacttgttgatgttggtggaggtaatggtactactattaaagccatttctgatgcatttccacacattcagtgcactctctttgatcttcctcatgtcatagccaattcttatgaccaccccaatatccaacgaattggaggtgacatgttcaagtctgtgcctagcgctcaagccatcttactcaagttaattttgcatgactggagtgatgaggatagtattaagattttgaagcaatgcaaggcagccttgacggaaaatggaggcaaggtgattatagtggacgtagcactagatgaggactcagaccatgagctgagtagcacaaggttgattcttgatattgatatgttggtgaatactggtggcagagaaaggactaaagaagattgggagaggctggttaagtctgcagggtttagtggctgcaacatcaggcacatagcggctattcaatcagtgattgaggtctttccatag

SEQ ID NO: 461 - DNA, 1065 bp, Nigella sativa
atggaggagatgataaatggagatgaatcaaaagaaattcttaaagctcaagctcacatatggaagtatacattcaattacataacttccatgtccctaaagtgtgcagtccaattaggtatacctgatatcattgctaatcatggtaagcctctcaacctctctcagttggtgaatgaactctcaatccctcacctgaaatctccacatctataccggctcatgcgcatattggttcactctggcttctttgccattgaagaaggagaaggttatgtcttgacaccttcatctaagctgcttctttccaagaatcaaaacacaaacttgtcaccttttgtcctaatgatgatggatcctgtcttagttacaccatttcatttcctaactgattggtttcaagggaatcaaactacagcattcaaggtagctcatgggatggagatgtgggattattatggccaacactctgatgttaacaagtcctttgatgattcattggctggtgactcagggttggtgatgggtgttgtgcttaaacactggaaggagatgtttcaagggtttggttcattggtggatgtaggtggcagcacaggtagtgtagccaaggctatctctgaggtatttccactcatgaaatgcactgttcttgatcttcctcatgtcgtctctgacatgaaagggagtaaaaacttggaatttattagtggagacatgttcgagtacatcccccctgcagatataatcctacttaagtggataatgcatgattggagcgacgagaaatgcataaagatactaaagaattgcaaggaagcgatatcggaacacaaaggaggaaaagtggttgtaatagacattatactggatgaagaccaaggattaagaagaaatgattcagttgaaactcagctttgccttgacattttaatgatggtttcacatgctgcaaaagaaagaactgaggctgaatggaagaagctcttcttagatgccggtttctcaagcttcaaggttactcgtggtttgggtttaagatctatcattgaagtcttcccttag

SEQ ID NO: 462 - DNA, 1068 bp, Papaver bracteatum
atgggtagcttagcaaaaccagctgaaacacaagaagtttccatcaaagatcaagctcaactatggaatattatctatggttttgctgattctcttgttctgcgttgcgctgtagagattggaatcgcggatattatcaaaaacaatgatggggcaatcacacttgcacaacttgcttcgaaactcccggttccaaatgtcagttctgattacttgtacagaatggtgagatacttggtacacctgaacatcttagcacaagaaacttgtaatggcggagttgagaaggtttactcgcttaaaccggttggtacgctacttttaagagatgcagaaagaagtatggtgccgatgatattaggcatgactgaaaaagatttcatggtttcatggcatttcattaattcaggtttaggagctggaggtggggtggtttttgcgggaggaatgggaatggatatatggaagtatttagaaagtaatcctgatcagagccagttgtttaatgaaggaatggctggagaaacaagacttttaactaaaactctgatcgaagattgcagagatacttttcaaggtttggattcactggttgatattggtggaggaaatggtacaacaatcaaggcaatccatgaagcttttcctcatatcaaatgttcactttatgatcttcctcatgttgttgccaactctcatgatctccctaacatcgaaaaagttcccggtgatatgttcaagtctgttcccagtgctcaggctatcttactcaagttgatcttgcacgactggactgatgaggagtgtgtcaacatcctaaagaagtgcaaagaagcaataccgaaagagacaggaaaagtgattatagtggatgtagcacttgaagaagaatccaaccatgaacttacaaagacaagattgattcttgatattgacatgttggtgaatactggtggtagagagaggactgcagatgattgggaaaatttgctcaaacgcgcaggctttcgctctcataggatcagacccattcgcgctattcagtctgtcattgaagccttcccttag

SEQ ID NO: 463 - DNA, 1074 bp, Papaver bracteatum
atggatactttatatgccaacccagctgaaacacaagaagaaatcggcatcaaagatcaagctcaaatatggaatttaatctatggttttgctgattctcttgttcttcgttgcacagtagagattggcttaccagatattatcaaaaacaataatgggccaatcacacttgcacaactttcatcaaaactcccgattccagacgtcaattctgaccacttgcacagaattcttagatatttagtacacctgaatatcttacgacaagaaacttgtaatggtggagctgataaggtttactcacttaaaccagctggtactttacttctaagtgatgcagaaggaagtatgataccaatattattagggatgactgaaaaagatttcatgcttccatggcattttatgaaagaaggtttaggaaatggaagcacaacagcatttgagaaaggagtgggaatggatgtatgggagtatttagaagctaacccagatcaaagtcggttgtttgatgaaggaatggctgcaacaacaagacttttaagtaaaactctagttgaagattgtagaggtacttttgaaggtttggattctcttgttgacgttggtggaggaaatggtacaacaatcatggcaatctctgaagcatttcctcacatcaaatgtacactttttgatcttccacgtgttattgctagctcacataatcaccctaacatcgaaagagttccaggtgatatgttcaagtctgttcccattgctcaagctatcttgctcaagatggtattgcatgactgggatgatgaagcgtgtgttaaaattctaaagaagtgcaaagaagcaataccgaaggagacggggaaagtgatcatagttgatgcagcacttgaagaagaatctgaacacgaacttacaaagacaagattgattcttgatattgatatgttggtgaattctggtggtagagagagaactgcagatgattgggagattttgctcaaacgtgcaggctttaggtctcataggatcagacccattcgcgctattcagtctgtgattgaagccttcccatag

SEQ ID NO: 464 - DNA, 1059 bp, Sanguinaria canadensis
atgggtataaatgataagccagaatctcaagaggttgacatcaaagctcaagctcatctctggagcataatctatggctttgctgattctctagtcctacgttgtgcagtagaaattgggattgcagatatcatcaaaaacaacaatgggtcaatttctgttacagaactctcatcaaaactcccaatctcaaacgtcaattctgataacctgtatcgtgtcttacgatacttggtacacatgggtatcttgaaagaagattcagacaataatggagtcaagctttactcacttcaaccagtagctactctgctcttaagagatgcagagaggagtatggtacccatcattttaggaatgacacaaaaggatttcatggttccatggcattttatgaaggaaggtttaggaaatgggggtactgcatttgagaaagggatggggatgacaatttggcagtacttggaagggcatccagaacagagccagttattcaatgaaggaatggctggtgaaactaggttactgactaaatcacttattgaaggttgtaaggatacatttgaaggtttaacatctcttgtagatgttggaggaggaaatggcacaacaattaaggcaatttatgatgcatttcctcatataaaatgcagtgtttatgatcttcctcatgttattgctagctctcatgatctcccaaatattgagaggattcctggtgatatgttcaagtctattcctagtgcacaagcaatcttactcaagttgatcttgcatgattggactgatgaagagtgtgtcaacattctaaaaaagtgtaaggaagcagtaccaaaagagacagggaaagtgatcatagtggatgtagcactggaagaagagtcccaacatgaacttacaaagacaagattgatacttgatattgatatgttggtgaatactggtggtagagagagaactgaagatgattgggaaaagttgctcaaacgtgcaggctttagaggtcataagatcaggcacattgcagctattcagtctgtcattgaagccttcccatag

SEQ ID NO: 465 - DNA, 1047 bp, Sanguinaria canadensis
atggaagcaaacaagagtgatcaagcaacccaagctaaaatctggaaactcatctatggtttcgctgaatccctagtcctcaaatgtgcagtccaactcgaaatcgccgatacaattcataaccacggcaaacccatgactctatccgagttagcttctgaacttccgattcaaccagtcaactcagacagattatacagagtcatgcgttacttagttcacatgaagctcttcaacaaagaaaaaagcaccattaatggcgaattcaaatactcacttgccccacctgcaaaattcctgataaagggttgggagaaatcaatggtggcttcaattctagcaatcaatgataaggatttcttggctccttggcatcatttgaaggatggtttggttggggattgtgatgtttttgagaaagctttggggaaaagtatttgggtttatatgagtgagaatcctgagaagaatcagctttttaatgaagcaatggcttgtgatacaagattggttacttcagctttggtaaataattgtggaaatgttttccatggaattaaaacacttgttgatgttggtggtggaactggaactgctgtgaaagctatttccaaggctttccctcatattaaatgcactatttatgatcttcctcatgttattgctgattcccctgagattccaaatattgttaaaattgaaggggatatgttcaagtccgttccaagtgctgatgccatcctaatgaagtgtattcttcacgattggaacgacgaggaatgcattcagattctaaagaaatgcaaagaagcagtaccgcgagaagggggaaaggttatcatcgtcgatgttgtactaaacatggactcgacgcatccttattccaagattagatttacattggatttggacatgatgcttaacactggaggaaaagagagaacactggaagaatggaagaagctgattgatgctgcagggtttgctagtttcaaaataactcaaatgtctactgtccaatctgtaattgaggcttatccttattaa

SEQ ID NO: 466 - DNA, 1059 bp, Stylophorum diphyllum
atgggtgtgaatgatatggcagtatctcaagaggttgacatcaaagctcaagctcatctctggaacatcatctatggctttgctgattctttagtcctccgttgtgcagtagagattggaattgcagatatcatcaagaacaacaatgggtcaatctctgtttctgaactctcatcaaagctcccaatctcaaacgtcaattctgataacctctaccgtgtcctaagatacttggtacacatgggtatcttgaaagaagattcagacattaatggagtcaagcttttctcactccaaccagtagctactctgctcttaagagatgcagagaggagcatggtacccatcattttagggatgacccaaaaggatttcatggttccatggcattttatgaaagaagggttgggagatgggagcactgcatttgagaaagggatggggatgaccatttggcagtacttggaaggtcatccagaacagagccagttgttcaatgaagggatggctggggaaactaggttactgactaaatcacttattgagggttgtagagatacatttgaaggtttgacatctcttgttgatgttggaggaggaaatggcacaacaattaaaggaatttatgatgcatttcctcaaatcaaatgctctgtttatgatcttcctcatgttattgctagctctcctgagcacccaaatattgaaagaattcctggtgatatgttcaaatctgttcctagtgctcaagctatcttactcaagttgatcttgcacgattggaccgatgaagagtgtgtcaacattctaacaaagtgtagggaagcagtaccaaaagagacagggagagtgatcatagtagatgttgcacttgaagaagagtcccaacatgaactcacaaagacaagattgatactggatattgatatgttggtgaacactggtggtagagagagaactgaagatgactgggaaaagttgatcaaacgtgccggctttagaggtcataagatcaggcacattgcagctattcaatctgtcattgaagccttcccatag

SEQ ID NO: 467 - DNA, 1077 bp, Stylophorum diphyllum
atggcattgcaaagtgatgagcaagtgttgcattctcaaactcacatatggaaccatattttcagcttcataaactccatgtccctcaagtgtgcaatccagctagaaatacccgatatcattgaacgccatggtgcaccaatgttgctctcggagttagtagacgccctctccatcaacaaggaaagagccccttttgtctatcgactcatgcgtttacttgtccactccggcttctttgtgaaacaaaaagtatcggaagaaagtgaagaaggctatttgctagctcctgcttctcgctttcttctaaaggaagagccattaagcattagaccttttttactagccatgctcgatccaatagtgatggatccatggcaacacctgagcaaatggttccaaaacaacgatatcaaccctttttacacagctcatgggaagaatccttgggagcttctacgccataagccagagcttattcaattaaccaatgaaggatgggctagtgattcaagacttgttacaagtgtgattcttaagcaatctggtactggtagtgctttttttgaagggttaaattctattgttgatgttggaggtggtactgggacggtcgctaaagccattgctgacgcgtttccaaaactcagttgcattagtttcgatcttcctcaagttgtcaatggtttggttggtggtaagaatctgagctttattggtggcgacatgttccaagagattcctaaagctgatgcagttctcctaaagtggatactacacggatggaatgatgaggaatgcttaaagatattaaagcgatgcaaagaggcgattccaagcaaagaaaatggaggaaaagtgataatcatcgacatggttgtgaaagatcaccaagggccgggtgacgatgaatttatcaaggcacaacttttctttgatatgcttatgatggcatcgcagacgggaagagagcgaaatgaaaaggattgggcaaagctatttcttgatgccggatttagtgattacaaaatcactcacaatttgggatcaaggtctttcattgaagtttacccatag

SEQ ID NO: 468 - DNA, 1056 bp, Tinospora cordifolia
atggaagctgcaactttgaagcaagatcaacaggcccaagccaagatatggaagttcatctatggcttctcagaatcactagtccttaaatgtgccattgaccttgaaatcccagacataattcacaaccatggcacccccatctccctctcccaactctcttctcaaatcgctccggccaagcagcctgtggattctgaccgcttataccgaatcatgcggtacttggttcacatggggctcttcaccgaagagagcatctccggtgagctccggtatggacttgcaccaccggctaagtacctcgtgaaggggtgggagaaaagcgtagtgccctcacttttatgtatcaatgataaggacatgatgtccccatggcactacttaaaggatagcactgttgccggagacaaccggacggcctttgagatggccttaggagtgaatatatgggattacatgggaaagaatcctaagaagaacagtgtgtttaatgaagcaatggcttgtgatactaggcttcttatgtctgcaatggtgaatgagtgtaaagatatgtttcaagggattaagtctctagtggacgttggagggggcactggaactgctgttaggaacattgctaaagcctttcctcacatcaaatgcactgtctttgatctccctcatgttgccgccgattcgccagtttatcccgaagttaaccgcatcgaaggagacatgtttaagggcattccaagtgctgatgccatcctaatgaagtgcatacttcatgattgggacgacaaggaatgcatagagatcctgaagaaatgtaaggaagctgttccggaagatggggggaaggtgatcgtggtggacattgtactaaatgcacactcagatcatccttacacaaagatgaggatggttatggacttggacatgatgttgaactgtggtggcaaagagagaacagaagaggaatggaagaagcttatttacgcagctgggtttagtaggtacaatatcaggcaaattaatgcaattcaatctgttattgagatttacccttga

SEQ ID NO: 469 - DNA, 1026 bp, Tinospora cordifolia
atggaagaagaaaggaatgcacaagcgctagtgtggagatacgcttacggcttcgccgattcgctgactctcaagtgcgcgattcaacttggcatcgcggacatcctccaccaacacggccagcccatgactctctccgagttagcctcatcgctccctctcccaaccgtaaaccaagaccgactccaccgaattatgcgctacctagtccacatgggcctcttcgacctagtcgactcagacacaaaatacgcactcaaccccgcgtcaaccctcctcgtgagaacccaacccaagaacctcgcttctttcgctcttcttcagtactacgagatggacgcgtggcaccacctcagcgccgccgtggaaggccacgtgacgccgtgggagaagtgtcacggcaccgattacagagagtactttgcaaaggacgaggtagcgaatcagttgctgagcgacgccatgacaagtcataccagtatggtgacggaggcgctcgtggaaggttgcaagaagggtaaggtgcttgatggggtccggtcatttgttgatgttggtgggagcaccggcgtggctgctcgcgcggtggccaaggcttttccgtgggtcaagtgtgcggtgtttgacttacctcacgtgattgctaccgcaccggagtgcccgggggtggagaggattgcaggggacatgttcgcgtccgtgcccgaaaccgatgtcgtcttcatgaagtcggtattgcatgactggggagacgaggattgtgtgaagatactaaagaaatgtaaggaagcaattggtgggaagaaggaagggaaagtggtgatattagatatagtgttggatgcaaaatccagtaatgagttcgagggagcgaggctggggatggacatggacatgttggtgactgtgggaggcaaggagaggagtgaggaggaatggaagaagctgttcaaggattcaggttacagtcactacaagatcacccctatagtggccattgaatccattattgaactcttcccttaa

SEQ ID NO: 470 - DNA, 1047 bp, Thalictrum flavum
atggcggctttccaaggaaaggatgaatctgtagacatcaatgctcaagctcatgtatggaaaatcatctatggatttgccgattcccttgttcttcgatgtgcagtggaacttggcattttcgatatcattgacaacaacaaccagcctatcacacttgccgatttggcatccaagctccccatatccaatgtcaatttggataatctgtttcggattttacgttacctagtcaaaatggaaatactgagttatgcaggtgtgaataaatacgcgcttgaaccaattgcgaaattggtccttaggaatgaaaaaaggagcatggttccaatggttcttggaatgactcagaaagattttatgactccatggcattcaatgaaagatggtttaactgacaatggtgttactgcttttgaaaaggccatgggcatgactatatgggaatacttagaaggacatccagatcaaagccaactattcaatgaaggcatggcaggtgaaacaaggcttctgacatcttcacttatatctggaagtaaagatttgtttcaaagtattgatgcagttgttgatgttggtggtggaaatggtactactataaaagcaatttctgatgcatttccacatatcaaatgtaccctttttgatcttcctcatgtcattgctaattcatatgatcacccaaatattgaacgtattggtggtgacatgttcaaaggcatgcctagtgctcaagccatcttactaaagctaattttgcacgactggaacgacgaagacagtatcaagattctaaagcaatgcagaaaagcagtaccaaaagatggagggagagttataatagtggatgtagcattggatgaagattcagaccatgagctaagcagtacaagattgattcttgatatagatatgttggtgaatactggtggtaaagaaaggactaaggaagattgggagaagctggttaagtgtgcagggtttagtggttgcaaaatcagacacattgcagctatacaatcagtgattgagattttcccataa

SEQ ID NO: 471 - DNA, 1026 bp, Thalictrum flavum
atggaagacctctcatcacaagctaaactatggaactacatctatggttttgctgattcactagttctcaaatgtgcagtccaacttgatctagccaacttaattcatgaccatggcacccccatgactctttctgagttatcttcacgtcttcctagtcagcctgtgaatcaagatgctttgtatcgagtcatgcgttacttggtccatataaaactattcaccaaatcatcaatagatggtgaattaagatatggtcttgcaccaccagctaaattcctagtgaaaggttgggataattgtatgattggttcaattctattgatggttgatacggattttatggctctgtatcattatatcaaggatgagatattgaacgatggtagttccataaccattaccgcttttgagaaggccttggggactaatatttgggagtacttggcagagcaccctgagaaaaatcagctatttaatgaagggatggctaatgagagtaggctgtattgcagcagtacttttgaaggtttaactacacttgtggatgttggtggcggtactggaactactgtgaagtatattgctaaagcatttccaaatattaagtatactgtttatgatcttcctcatgttattgctgatgcccctggagacactgaaatcaattttgtccaaggagatatgttcaaatacataccaaatgctgatgctatcttgatgaagggcgtccttcatgattgggacgataacgaatgcattgaaatcttaaagagatgcaaacacgcagtgccaagagatggagggaaagttataattattgatgttgtgttaaatgtgaaatcagaacacccttacactaaaatgagattgactttggatttggacatgatgctcaacaataaaggaaaagagagaaccgaagaagattggaagaagctcatttatgatgatgcaggatacaaaggatacaaaataacacaaatatctgctcttcagtcagtcattgaagcttatccttattag

SEQ ID NO: 472 - DNA, 1053 bp, Xanthoriza simplicissima
atggctttccatggaaaagatgatgctctggacatcaaagctcaagctcatgtgtggaaaatcatctatggttttgcagattctctagtcctccgatgtgcagtggaacttggaatcgtcgacatcattgataacaacaaccaacccattgcacttgcagatttggcctctaagcttcctgtttccaatgtgaattgtgataatttgtatcggatattacgatacttggtgaaaatggaaatattgaggctggaaaattctgatgatggtgagaagaaatacgcacttgaacctattgcgacattgctttcaaggaatgcgaagaggagtatggttccaatgattcttggaatgactcaaaaagattttatgactccttggcattcaatgaaagatggcttaagtgacgatggtactgcttttgagaaggccatgggaatgactatatgggagtacttggaaggacaccctgatcaaagccaattattcaatgaaggtatggctggcgaaacaaggcttctcacatcttcactcatatctggaagtagagatatgtttcaaggtattgactcacttgttgatgttggtggaggaaatggtactactatcaaggccatttctgatgcatttccacacatcaagtgcaccctctttgatctccctcatgtcattgccaattcctatgaccatcctaatattgaacgcattggtggtgacatgtttaaatctgtgcctagtgcccaagctatcttactcaagctaattttgcacgattggaatgacgaagactcgatcaagattttaaagcaatgcagaaatgcagtgccaaaagatggagggaaagtgattatagtggatgtagcattggatgaggagtcagaccatgagcttagcagcacacgattgatacttgatatcgatatgttggtgaacactggtggtaaagagaggactaaagaggtttgggagaaaattgttaaaagtgcaggattcagtggttgcaaaatcaggcacatagcagctatacaatcagttattgaggtttttccatag

SEQ ID NO: 473 - DNA, 1065 bp, Xanthoriza simplicissima
gagatcattaaaggtgatggaacgaaagaggtacttgaagctcaagctcatatctggaactacacatttaactacataacttctatgtcactcaggtgtgctgttcaactaggcataccagatatcatcgacaaccatgacaaacctgtcaccctctctgagttggtgaaggcactttcattccctcaggtgaaatctgctcacgtttaccgcctaatgcgggttttggtgcactctggcttcttcactgtaggaaaaattcatgaacaagaagaggagtatatgttgacgccttcgtctaagctcctaatgaagaaccatgtgacaaacttagcaccattcctattaatgatcactgatcctgttattgcaaattcttgtcacttcatgacttccttgttccaggggtctgaggttttaccgattgaggttgcccatgggatgagtttatggaattactgtaaccaacaccctgaatttaaccagttgtttaatgatgcaatggctagtgacacaaatttcgtgttgagtgtagtggttaaagagtataaggcaatttttgaaggttttaggtccctagttgatgtagggggtggaataggaactgcagccaaggctatttcaaaggctcttccacacttgcgatgcacggttcttgatcttcctcatgtagtctcaaacatggtagggaatgcaaacatagaatttgttagtggcgacatgtttaaatatgttcctcccgctgatatagtcctgctgaagtggattatgcatgattggaatgatgaggaatgcgtgaagatactacaacgatgcagggaagcacttccggcaaaagaaaagggagggaaggtgattataatagatgtagtggtggactgcaataaaggaaagtttgaaacaactgaagcacaactttgcttcgacatattgatgatggtttgtcttactggaaaagagagaactgagaaagaatgggagaaattattcatggaatctggttttacaagttacaagataactcatggtttgggtttgaggtctattattgaagtattcccttaa

SEQ ID NO: 474 - protein, 356 aa, Argemone mexicana
MGVNDKQDQNQEVDIKDQAHLWNIIYGFADSLVLRCAVEIGIADIIKNNNGSISVSELASKLPISNVNSDNLYRILRYLVHMSILKEETSSDINGGNKLYSLQPVGTLLLRDAERSMVPMILGMTQKDFMIPWHFMKEGLGNGETAFEKGMGMTIWEYLEGHPDQSQLFNEGMAGETRLLTKSLINGCRDIFEGLNSLVDVGGGNGTTIRAIYNAFPHIKCKLYDLPHVIANSLDQPNIECIPGDMFKFVPTAQAILLKLILHDWTDEECVNILKKCKEAIPKETGKVIIVDVALEEESKHELTKTRLILDIDMLVNTGGRERTADDWENLLKRAGFRSHKIRSIAAIQSVIEAYP

SEQ ID NO: 475 - protein, 357 aa, Argemone mexicana
MEVNKIDQENQSKIWKQIYGFADSLVLKCAVQLEIAETIHNHGKPMSLSELASKLPIQPINLDRLYRVMRYLVHMKLFNKEIITINGDINNTETVIKYSLAPPAKYLIRGWEKSMVASILAINDKDFLAPWHHLKEGLTGNCDAFEKALGKSIWVFMSENPEKNKLFNEAMACDTRLVTSALVNECKNIFCDDGIKTLVDVGGGTGTAMKAISKAFPNINCTIYDLPHVIADSPEIPNITKIAGDMFKSIPSADAILMKCILHDWDDEECIKILKLCKEAVPRKGGKVIIVDVVLNMDMTHPYSKIRLTLDLDMMLNTGGKERTEEEWKKLFDAAGFATYKITQISAVQSVIEAYPY

SEQ ID NO: 476 - protein, 350 aa, Berberis thunbergii
MELNGKDESVDIKAQAHLWKIIYGFADSLVLRCAVELGIADIINDNNQPITLPDLAAKLPVSNVNFDHLYRILRYLAHMKLIKQEEKRGVTLYSLEPIGTMLVKNAKRNMVPIILGMTQKDFMTSWHFMKDGLSNDGTTAFEKGMGMTIWEYLEGHPEQSQLFNEGMAGETRLLTSSLINGSRDLFKGINSLVDVGGGNGTTIKAISDAFPHIKCTLYDLPHVVANSYDLPNVERIPGDMFQSVPSAQAILLKLILHDWSDEDCIKILKKCKEAVPKEGGKVIIVDVALDEESDHELTSTRLILDIDMLVNTGGKERSKEDWDKLIKAAGFKGFNIRHIAAVQSVIEVFP

SEQ ID NO: 477 - protein, 353 aa, Berberis thunbergii
MAANSEMVEENIIANQAKLWNSIYGFSETFVLRCAVELDIATIIHNHGKSMTLSELVSQLTVKQPVNSDSLSRLMRYLVYIDIFTDTVDVDRETRYGLAPLGKFLVKGSDHCVVEEMLVVTDKEFMAPWQCIKDGITDGSKTAFEKTFGMNIWEYMGKHSEKNTTFNEFMASDSRIMSSELVNKCKDKFQGLNSLVDVGGGTGTTARSIAKAFPSIKCTVYDLPIVLADSLVCPEITQVSGDMFKFVPSADAVLLKYILHDWGDKECIEILKRCKDAVPKDVGKVIIIDTVLDVKSDHPYTKLKLSLDLDMMINTGGKERSEEEWKTLIQAAGFKNYNITQLSALPSVIEAFP

SEQ ID NO: 478 - protein, 349 aa, Chordyalis celanthifolia
MGVNDIAEVQDVDLKAQAHLWNIIYGFADSLVLRCAVELGIADIINSNNGPVTISEIASKLPVDNVNTDNLYRVLRYLVYMGLLKESQNKCYSLEPVATLLLKDAQRSMVPIILGMTQKDFMVPWFFMKEGLGSGSSTAFEKGMGMTLWEYLEGHPDQSQLFNEGMAGETRFLTSSLINGCRDTFEGLTSLVDVGGGNGTTIKGIHDAFPHIKCSVYDLPHVIANAHPHPNIERIPGDMFKSVPSAQAILLKLILHDWTDEESVNILKRCREAVPKEGGKVIIVDVALEEGSQHELTKTRLILDIDMLVNTGGRERSVDDWDRMLKLAGFSSHKIRHIAAIQSVIEAFP

SEQ ID NO: 479 - protein, 347 aa, Chordyalis celanthifolia
MEVIKKSDQADQAKLWKFIYGFADSLVLKCAVELEIADTIHKHGEPMTLSELATKLPKQPIDTDRLYRIMRYLVQMKLFTKETSQSGEVKYGLLPPAKFVVRGWQNSMVGSLLAINDKDFIAPWHYLKDGLGGECDAFEKALGKKIWDYMSENPEKNQLFNEAMACDTRHILISALIKDCKDVFKGIKTLVDVGGGTGTAVKAISDAFPDIKCAVYDLPHVIADSPVAPNIDRIEGDMFKSIPNADAIFMKCILHDWNDDECIQILKQCKKALQDGGKVIIVDVVLNVDSKHPYTKMRLTLDLDMMLNTGGKERTEEEWKELFEAAGFSGYKIIQISALQSVIEAYP

SEQ ID NO: 480 - protein, 352 aa, Chelidonium majus
MGVNDMAVSQEVDIKAQAHLWNIIYGFADSLVLRCAVEIGIADIIKNNNGSISVSELSSKLPISNVNSDNLYRVLRYLVHMGILKEDSDINGVKLYSLQPVATLLLRDAERSMVPIILGMTQKDFMVPWHFMKEGLGDGSTAFEKGMGMTIWQYLEGHPEQSQLFNEGMAGETRLLTKSLIEGCRDTFEGLTSLVDVGGGNGTTIKGIYDAFPQIKCSVYDLPHVIASSPEHPNIERIPGDMFKSVPSAQAILLKLILHDWTDDECVNILTKCREAVPKETGRVIIVDVALEEESQHELTKTRLILDIDMLVNTGGRERTEDDWEKLLKRAGFRGHKIRHIAAIQSVIEAFP

SEQ ID NO: 481 - protein, 356 aa, Chelidonium majus
MGSSSIDVKPAETQEVSIKDQAQLWNMIYGFADSLVVRCAVELGIPDIIKNNNGPITLAQLSSKLPIPNVNSDHLYRIVRYLINLNILQQEICRNVKVYSLKPVGTLLLRDAERSMVPILLGNTQKDFLVPWHFVKEGLVNGSTTAFEKGMGMDIWKYLEGNPDQSQLFNEGMAGETSLLTKTLIEDCRDTFQNLDSLVDIGGGNGTTIKAIYEAFPHIKCTLYDLPHVVANSHDLPKIEKVPGDMFKSVPSAQAILLKLILHDWTDEECVNILKKCKEAIPKETGKVIIVDVALEEESNHELTKTRLILDIDMLVNTGGRERTADDWENLLKRAGFRSHRIRPIRAIQSVIEAFP

SEQ ID NO: 482 - protein, 369 aa, Cissampelos mucronata
MTVLEGLTISVLCTPITSFGKNTMEEAMDVHEQAHLWKLIYGFVDTLVVRSAVELGIFDIINNNLKPMTVLDLASKLPISNPCSDRLYRILRYLVHVRLLKVTDIDGLKRYSIQPVARFLLRDYDKSMAPIILGMTKKEFMSSWHHIKDGLSDDGSTAFDKAMGMSFFEYLEENPSQSKLFNEAMAGETRLLTASLINDCKDIFQGIESLVDIGGGNGTTIKAISDAFPHISCALFDLPHVVADSNDDHPNIKRVAGDMFESIPTSQAILLKLILHDWSDEDCVRILKRCREAVPKEGGKVIIVDVALEEESKHELNNPRLVLDIDMLVNTGGKERSREDWEKLTKLAGFGGYKIRHIAAIQSVIEITP

SEQ ID NO: 483 - protein, 343 aa, Cissampelos Mucrronata
MEEEMKAQAQVWRYVYGFADSLTLKCAIQLDIPDILHRHGRPLSLSALASRLPLPTVNPDRLHRLMRYLVHMGLFDLVPSPDEPAYASNPSSALLVKGQPKSLASFALLQYYEMDAWHHLSAAVEGSVTPWERCHGVDYREYFAKDPVANQLLSDAMTSHTSMVTEALVEGCRKAGALDGVRSFVDVGGSTGVAARAVAKAFPGIKCSVFDLPHVIATAPECPEVERIEGDMFASVPETDVVFMKSVLHDWGDEDCVKILKKCKEAIAGKEGGKVVILDIVLDVESSYEFKGARLGMEMDMLVTVGGKERSEAEWQKLIKDAGFSRYKITPIVAIESIIEVFP

SEQ ID NO: 484 - protein, 342 aa, Cocculus trilobus
DQAAQAQLWKFIYGFAESLVIKSAIQLDIPDIIDNHGKPITISELASRIPSQGPVDHDRLYRIMRYLVHMKLFTKESIDGEDQYGLAPPAKYLVKGWEKSIVPSILCITDKEFMSPWYHLKEGLSNGDNQTAFEKALGVNIWDYMSKNPKKNNIFNEAMACDTRLLMSALVSECKDMFQGIKSLVDIGGGTGTAVRYIAKAFPHINCTVYDLPHVAADSPTYPEVNRIEGDMFKYIPSADAILMKCILHDWADEECIQILKKCKEALPSTGGKVILVDIVLNAYSEHPYSKMRMVMDLDMMLNCGGKERTEEEWKKLIYAAGFSRYNIRQVNAIQSVIEVYP

SEQ ID NO: 485 - protein, 343 aa, Cocculus trilobus
MEEEMKAQAQVWRYVYGFAESLTLKCAIQLNIPDILHQHGRPMTLSELASHLPLPTVNQDRLFRVMRYLVHMGLFDLVDSPDSKKYSLNSASKLLIKGQDKSLASFALLQYYEMDAWHHLSAAVEGGATPWEKCHGVDYREYFSKDSVANQLLSDAMTSHTSMVTEALVEGCKKANVLDGVRSFVDVGGSTGVAARAVAKAFPNVKCSVFDLPHVIATAPECPEVTRIEGDMFVSIPETDVVFMKSVLHDWGDEDCVKILKKCKEAIAGKDGGKVVILDIVLDAESSYEFKGARLGMEMDMLVTVGGKERGEEEWQKLFKAAGYSRYKITPIVAIESVIEVFP

SEQ ID NO: 486 - protein, 353 aa, Eschscholzia californica
MGLEFNEEVDIKAQAHLWNIIYGFADSLVLRSAVELGIADIIKNNNGSITVSELASKLPISNVNSDNLYRVLRYLVHMGILKETKSTINGGEIKKLYSLEPVGSLLVKDAERNMVPIVLGMTQQDFMIPWHYIKEGLGEGSTAFEKGMGMTLWEYLEGHPEQGHLFNVGMEGETRLLTKTLIESCKDTFEGLSSLVDVGGGNGTTIKAISEAFPHIKCSLYDLPHVVADSHDLPNIEKIPGDIFKFIPNAQAILLKLILHDWSDEDSVKILKKCREAVPQDTGRVIIVDVALEEESEHPLTKTRLVLDVDMLVNTGGRERSEDDWAKLLKLAGFRTHKIRHIAAVQSVIEAFP

SEQ ID NO: 487 - protein, 348 aa, Eschscholzia californica
MEGADKIDQATQAKIWKHIYGFAESLVIKSAVELEIADTIHNHGKPMTLSELASKLPVQPVDLDRLYRVMRYLVHMKLFKKQEDEEESIKYSLLPPAKFLIKGWEKSMVSAILLINDKDFMSPWHHLKEGLVNNSNAFDKALGKSIWDYMSANPDKNKVFNEGMACDSRLVSSALVNECGNIFQGIQTLVDVGGGTGTAVKAVSKAFPHIKCSIYDLPHVISDSPDIPNIVKIEGDMFKSIPSADAILMKCILHDWNDEECIEILKKCKEAVPKEGGKVIIVDIVLDMESKHPYSKVRLTLDLDMMLNTEGKERTEEEWKKLIDGAGFASYKITQISALQSVIEAFPY

SEQ ID NO: 488 - protein, 353 aa, Glaucium flavum
MGVSDNKPESQEVDIKAQAHLWNIIYGFADSLVLRCAVEIGIADIIKSNNGSISVTELASKLPITNVNSDNLYRVLRYLVHMGILKEVSDSNEVKLYSLQPVATLLLRDAERSMVPIILGMTQKDFMIPWHFMKEGLGNDTTAFEKGMGMTIWQYLEGHPEQSNLFNEGMAGETRLLTKSLIDGCRDTFEGLTSLCDVGGGNGTTIKGIYDAFPQIKCSVYDLPHVIASSPEHPNIERIPGDMFKSVPSAQAILLKLILHDWTDEECVNILIKCREAVPKDTGKVIIVDVALEEESQHELTKTRLILDIDMLVNTGGRERSEDDWEKLLKRAGFRGHKIRHIAAIQSVIEAFP

SEQ ID NO: 489 - protein, 348 aa, Glaucium flavum
MEATKSDQANQANIWKLIYGFAESLVLKCAIQLEIADTIHNHGEPMSLSELASKLPVQPVNSDRLYRVMRYLVHMKLFNKEKTSINGEFKYSLAPPAKFLIKGWEKSMVASILAINDKDFLAPWHHLKDGLSGDCDAFEKALGKSIWVYMSENPEKNQLFNEAMACDTRLVTSALVNDCQSVFKGINTLVDVGGGTGTAVKAISKAFPHIKCSIYDLPHVIADSPEIPNVVKIEGDMFKAIPSADAILMKCILHDWNDDECIQILKKCKEAVPQEGGKVIIVDVVLNMDLTHPYSKIRLTLDLDMMLNTGGKERTVEEWKKLIDAAGFASFKITEISAVQSVIEAFPY

SEQ ID NO: 490 - protein, 353 aa, Hydrastis canadensis
MDANGNKDHESSDIKSQAHLWKIIYGFADSLVLRCAVELEIFDIIDNNNQPITVSELASKLPIADVNSDNLYRILRYLVQMKILKLNKVVDDGVNKYSLQPIAALLLRNSKRNMVPIILGMTQKDFMTSWHSMKDGLSNNGTAFEKGMGMTIWEYLEGHPEQSQLFNEGMAGETRLLTSSLISGSKDMFQSIHSLVDVGGGNGTTIKAISDAFPHIKCTLFDLPHVIANAYDHPNIERIPGDMFKSMPSAQAILLKLILHDWSDEDCIKILKSCKEAVPKDGGKVIIVDVALDEESDHELTSTRLILDIDMLVNTGGRERSKEDWEKLVKCAGFKGCKIRHIAAVQSVIEVFP

SEQ ID NO: 491 - protein, 356 aa, Hydrastis canadensis
MEIKMEGVEGHELLEAQAHIWNHTFNFITSMTLKCAVQLGIPDIIYNHGQPITLSELVKALSIHQMKSDYLYRLMRILVHSEFFAIQKIHEDQEGYVLTPSSKYLLKNQLTNLSPYILMVLDPVLVTPCHFMSAWFQGNESTPFEVAHGMSFWEYCGQHPDIRKYFNKAMASDAELVMTVASKECKTMFEGFKSLVDVGGGTGTMAKAISKSFPHLKCTVFDLPYIVSNLQGSENIEFVGGDMFESVPPGDIFLLKLILHDWKDEECVNILKRCREAISLENKGGKVIIIDMIVDDNRGKYESTEAQLCFDMLLMVLVTGKERTESEWEKLFLEAGFTSYKITPALGLRSFIEVFL

SEQ ID NO: 492 - protein, 351 aa, Jeffersonia diphylla
MEVNGKTNEAVDIKAQAHLWKIIYGFADSLVLRCAVELGIADIIDNNNQPITLSDLASKLPLPSVNIDYLYRIMRYLVHMKLFKVEENINGVKQYSLQPTGTLLLRTAERNMVPMVLGMTQKDFVTPWHFMKDGLSDDGTAFEKGMGMTIWEYLEGHPDQSQLFNEGMAGETRLLTSSLISGCGDLFKGITSLVDVGGGNGTTLKGISDAFPHIKCTLFDLPYVIANSYDHPNIERIAGDMFQSVPSAQAILLKLILHDWSDEDCIKILKKCKEAVPKEGGKVIIVDVALDEESDHELTSTRLILDIDMLVNTGGKERTKEDWNKLVKAAGFRGFNIKHIAAVQSVIEVFP

SEQ ID NO: 493 - protein, 351 aa, Jeffersonia diphylla
MEAKTGFEISSQANLWNFIYGFSNSLVLRCAVELDIANIIHNHGMPITLSELELLLPVQPVNTASLYRVMRYLAHIKIFTKTLDVDGETRYGLTPSAKFLVKGWDQCTVGAILGITDKDFMAPWHYIKDGLTGDSKKTAFEKALGMDIWKYMGDHPEKNKLFNAAMACDSRLAMSALINECKDKFQEITSLVDVGGGTGTAARNIAQAFPHIKCTVYDLPHVIADSPVYPELNSVAGDMFKCVPNADAIFMKCILHDWDDKECIEILKQCKEAVPKQGGKVIIVDIVLNMKSDHPYTKLRLTLDLDMMLNTGGGKERTEEEWKKLFQAAGFRGYNITQISALQSVIEAFPY

SEQ ID NO: 494 - protein, 350 aa, Mahonia aquifolium
MELNGKDESVDIKAQAHLWKIIYGSADSLVLRCAVELGIADIINDNNQPITLPDLASKLPLSNVNIDHLYRILRFLAHMKLIKQEEKQGVTLYSLEPIGTLLVRNAKRNMVPIILGMTQKDFMTSWHFMKDGLSNDGTTAFEKGMGMTIWEYLERHPEQSQLFNEGMAGETRLLTSSLINGCRDMFKGINSLVDVGGGNGTTIKAISDAFPHIKCTLYDLSHVVANSYDLPNVERIPGDMFQSVPSAQAILLKLILHDWSDEDCIKILKKCKEAVPKEGGKVIIVDVALDETSDHELTGTRLILDIDMLVNTGGKERSKEDWDKLVKAAGFKGFNIRHIAAVQSVIEVFP

SEQ ID NO: 495 - protein, 349 aa, Mahonia aquifolium
MGEENIANQAKLWNIIYGFADSLVLRCAVELDIANIIHNHGKSMTLSELASVLPVKQPVNSDSLYRVMRYLAHLRVFTKTLDADGETRYGLAPPANFLVRGNDNCMVGSLMGLTDKEFMAPWHYIKDGLSGDDGKTAFEKALGMDIWEYMGENPEKNKLFNEAMACDTRLVLSALINECKDKFQGLNSLVDVGGGTGTAARNLAKAFPHLKCTAYDLPHVIADSPVYPEITQVPGDMFKVIPYADAILMKCILHDWGDKECIQIVKKCKEALPKEGGKVIIVDIVLDVKSEHPYTKLRLTLDVDMMLNTGGGKERTEEEWKKLIQAAGFKSYNITQISALQSVIEAFPY

SEQ ID NO: 496 - protein, 355 aa, Menispermum canadense
MILDNHDKAEEALVVDVHDQAHLWKLIYGFVDTLVVRSAVELGIMDIIYNNKKPISLFDLASKLPVSNTCPDRLYRILRYLVHVRLLRVAEVDGLKKYLLAPAAKLLLRNTEKSMVPIILGMTQKDFVVPWHHINDGLGSEGATAFDKSMGMSFFEYLEENPSQSKLFNEAMAGETRLLTASLINGCKDLFQGIESLVDVGGGNGTTIKAISDSFPHIKCTLFDLPYVVADSHDDPNIKRVHGDMFKSIPSSQAILLKLILHDWSDEDCVKILKRCKEAVPKEGGKVIIVDVALDEESQHELSSTRLILDIDMLVNTGGKERSKEDWEKLIKCAGFGGYKIRHIAAIQSVIEVFP

SEQ ID NO: 497 - protein, 350 aa, Menispermum canadense
MDTTINGSLLEADHNLQVKAQAHVWNTIYRFSDSLILRAVIDLGILDIINSNNNSISLSELASKLPLHHVHHDHISRILRHLTHMKILRVVTADDDGDDNMITKYSLEPLVAALLLKSSEKSLAYNVLGMIQKEFVLPWHYIKDCLVGCDESTIFTTPFEKAMGVTFWEYLEGHLEDSKNFNESMASETRLLTASLIDGCRDVFESVGSIVDVGGGNGTTLKAISNEFPHIKCTLFDLPYVVANACDCPGIECVSGDMFKAIPSAQAILLKLILHDWGDEDCVKILKRCKEAVPSDVGKVIIVDVALEEDFEDELTGARLALDMDMLVTTGGKERTKEDWEKLVKRAGFR

SEQ ID NO: 498 - protein, 351 aa, Nandina domestica
MAMNGKANEFEDIKAQAHLWKIIYGFADSLVLRCAVELGIADIISNNNKPISLSCLASKLPLPHVNLDHLYRIMRYLVHMKLLKLVVNENGEKLYALEPISTLLLKDAKRNMVPMVLGMTQKDFVTPWHYMKDGLSDDGTAFEKGMGMTIWEYLQGHPDQSQLFNEGMAGETRLLTSSLISGCGDLFKSLTSLVDVGGGNGTTIKAISDAFPHIKCTLFDLPYVIANSYDHPDIERISGDMFKSVPSAQAILLKLILHDWSDEDCIRILKQCKEAVPKEGGKVIIVDVALDEESDHELTSTRLILDIDMLVNTGGKERTKEDWDKLVKAAGFRGFNIRHIAAIQSVIEVFP

SEQ ID NO: 499 - protein, 350 aa, Nandina domestica
MEVMKEQDVSAQAKMWNYIYGFSETLVLRCAVELDIANIIHNHGKPITLPELASKLPRQPVNSDSLYRVMRHLAHMKLFTKTKVDGDTKYELAPSAKFLVKGADKCMVGALLAITDKDFMAPWHYIKDGLTGDSKSTAFDKALGMDIWTYMGKHPEKNQLFNEAMACDTRLAMSALVNECKDKFNGIKSLVDVGGGTGTAVRNIAKAFPHIKCTVYDLPHVIADSLAYPEINRIAGDMFKSVPKADAILMKCILHDWADEECIEILKKCKEAVPEDGGKVIIIDIVLNVESDHPYTKMRLTLDLDMMLNTGGGKERTEEEWKKLIQAAGFRSYNITQISAVQSVIEAFPY

SEQ ID NO: 500 - protein, 349 aa, Nigella sativa
MAFYANDEALDVEAQAHVWKIIYGFADSLVLRCAVELEIFDIIGNNNSIQLSELASKLPVANVVPDHLYRLLRYLIKMELLRLETSNKGVKEYTLQPTARLLLRNEKRSMVPMILGNTQKDFMTPWHSMKDGLGHSGTAFEKSKGMTIWEYLETHPDQSQLFNKGMAAQTRLLTSSLISVNKDIFQSINSLVDVGGGNGTTIKAISDAFPHIQCTLFDLPHVIANSYDHPNIQRIGGDMFKSVPSAQAILLKLILHDWSDEDSIKILKQCKAALTENGGKVIIVDVALDEDSDHELSSTRLILDIDMLVNTGGRERTKEDWERLVKSAGFSGCNIRHIAAIQSVIEVFP

SEQ ID NO: 501 - protein, 354 aa, Nigella sativa
MEEMINGDESKEILKAQAHIWKYTFNYITSMSLKCAVQLGIPDIIANHGKPLNLSQLVNELSIPHLKSPHLYRLMRILVHSGFFAIEEGEGYVLTPSSKLLLSKNQNTNLSPFVLMMMDPVLVTPFHFLTDWFQGNQTTAFKVAHGMEMWDYYGQHSDVNKSFDDSLAGDSGLVMGVVLKHWKEMFQGFGSLVDVGGSTGSVAKAISEVFPLMKCTVLDLPHVVSDMKGSKNLEFISGDMFEYIPPADIILLKWIMHDWSDEKCIKILKNCKEAISEHKGGKVVVIDIILDEDQGLRRNDSVETQLCLDILMMVSHAAKERTEAEWKKLFLDAGFSSFKVTRGLGLRSIIEVFP

SEQ ID NO: 502 - protein, 355 aa, Papaver bracteatum
MGSLAKPAETQEVSIKDQAQLWNIIYGFADSLVLRCAVEIGIADIIKNNDGAITLAQLASKLPVPNVSSDYLYRMVRYLVHLNILAQETCNGGVEKVYSLKPVGTLLLRDAERSMVPMILGMTEKDFMVSWHFINSGLGAGGGVVFAGGMGMDIWKYLESNPDQSQLFNEGMAGETRLLTKTLIEDCRDTFQGLDSLVDIGGGNGTTIKAIHEAFPHIKCSLYDLPHVVANSHDLPNIEKVPGDMFKSVPSAQAILLKLILHDWTDEECVNILKKCKEAIPKETGKVIIVDVALEEESNHELTKTRLILDIDMLVNTGGRERTADDWENLLKRAGFRSHRIRPIRAIQSVIEAFP

SEQ ID NO: 503 - protein, 357 aa, Papaver bracteatum
MDTLYANPAETQEEIGIKDQAQIWNLIYGFADSLVLRCTVEIGLPDIIKNNNGPITLAQLSSKLPIPDVNSDHLHRILRYLVHLNILRQETCNGGADKVYSLKPAGTLLLSDAEGSMIPILLGMTEKDFMLPWHFMKEGLGNGSTTAFEKGVGMDVWEYLEANPDQSRLFDEGMAATTRLLSKTLVEDCRGTFEGLDSLVDVGGGNGTTIMAISEAFPHIKCTLFDLPRVIASSHNHPNIERVPGDMFKSVPIAQAILLKMVLHDWDDEACVKILKKCKEAIPKETGKVIIVDAALEEESEHELTKTRLILDIDMLVNSGGRERTADDWEILLKRAGFRSHRIRPIRAIQSVIEAFP

SEQ ID NO: 504 - protein, 352 aa, Sanguinaria canadensis
MGINDKPESQEVDIKAQAHLWSIIYGFADSLVLRCAVEIGIADIIKNNNGSISVTELSSKLPISNVNSDNLYRVLRYLVHMGILKEDSDNNGVKLYSLQPVATLLLRDAERSMVPIILGMTQKDFMVPWHFMKEGLGNGGTAFEKGMGMTIWQYLEGHPEQSQLFNEGMAGETRLLTKSLIEGCKDTFEGLTSLVDVGGGNGTTIKAIYDAFPHIKCSVYDLPHVIASSHDLPNIERIPGDMFKSIPSAQAILLKLILHDWTDEECVNILKKCKEAVPKETGKVIIVDVALEEESQHELTKTRLILDIDMLVNTGGRERTEDDWEKLLKRAGFRGHKIRHIAAIQSVIEAFP

SEQ ID NO: 505 - protein, 348 aa, Sanguinaria canadensis
MEANKSDQATQAKIWKLIYGFAESLVLKCAVQLEIADTIHNHGKPMTLSELASELPIQPVNSDRLYRVMRYLVHMKLFNKEKSTINGEFKYSLAPPAKFLIKGWEKSMVASILAINDKDFLAPWHHLKDGLVGDCDVFEKALGKSIWVYMSENPEKNQLFNEAMACDTRLVTSALVNNCGNVFHGIKTLVDVGGGTGTAVKAISKAFPHIKCTIYDLPHVIADSPEIPNIVKIEGDMFKSVPSADAILMKCILHDWNDEECIQILKKCKEAVPREGGKVIIVDVVLNMDSTHPYSKIRFTLDLDMMLNTGGKERTLEEWKKLIDAAGFASFKITQMSTVQSVIEAYPY

SEQ ID NO: 506 - protein, 352 aa, Stylophorum diphyllum
MGVNDMAVSQEVDIKAQAHLWNIIYGFADSLVLRCAVEIGIADIIKNNNGSISVSELSSKLPISNVNSDNLYRVLRYLVHMGILKEDSDINGVKLFSLQPVATLLLRDAERSMVPIILGMTQKDFMVPWHFMKEGLGDGSTAFEKGMGMTIWQYLEGHPEQSQLFNEGMAGETRLLTKSLIEGCRDTFEGLTSLVDVGGGNGTTIKGIYDAFPQIKCSVYDLPHVIASSPEHPNIERIPGDMFKSVPSAQAILLKLILHDWTDEECVNILTKCREAVPKETGRVIIVDVALEEESQHELTKTRLILDIDMLVNTGGRERTEDDWEKLIKRAGFRGHKIRHIAAIQSVIEAFP

SEQ ID NO: 507 - protein, 358 aa, Stylophorum diphyllum
MALQSDEQVLHSQTHIWNHIFSFINSMSLKCAIQLEIPDIIERHGAPMLLSELVDALSINKERAPFVYRLMRLLVHSGFFVKQKVSEESEEGYLLAPASRFLLKEEPLSIRPFLLAMLDPIVMDPWQHLSKWFQNNDINPFYTAHGKNPWELLRHKPELIQLTNEGWASDSRLVTSVILKQSGTGSAFFEGLNSIVDVGGGTGTVAKAIADAFPKLSCISFDLPQVVNGLVGGKNLSFIGGDMFQEIPKADAVLLKWILHGWNDEECLKILKRCKEAIPSKENGGKVIIIDMVVKDHQGPGDDEFIKAQLFFDMLMMASQTGRERNEKDWAKLFLDAGFSDYKITHNLGSRSFIEVYP

SEQ ID NO: 508 - protein, 351 aa, Tinospora cordifolia
MEAATLKQDQQAQAKIWKFIYGFSESLVLKCAIDLEIPDIIHNHGTPISLSQLSSQIAPAKQPVDSDRLYRIMRYLVHMGLFTEESISGELRYGLAPPAKYLVKGWEKSVVPSLLCINDKDMMSPWHYLKDSTVAGDNRTAFEMALGVNIWDYMGKNPKKNSVFNEAMACDTRLLMSAMVNECKDMFQGIKSLVDVGGGTGTAVRNIAKAFPHIKCTVFDLPHVAADSPVYPEVNRIEGDMFKGIPSADAILMKCILHDWDDKECIEILKKCKEAVPEDGGKVIVVDIVLNAHSDHPYTKMRMVMDLDMMLNCGGKERTEEEWKKLIYAAGFSRYNIRQINAIQSVIEIYP

SEQ ID NO: 509 - protein, 341 aa, Tinospora cordifolia
MEEERNAQALVWRYAYGFADSLTLKCAIQLGIADILHQHGQPMTLSELASSLPLPTVNQDRLHRIMRYLVHMGLFDLVDSDTKYALNPASTLLVRTQPKNLASFALLQYYEMDAWHHLSAAVEGHVTPWEKCHGTDYREYFAKDEVANQLLSDAMTSHTSMVTEALVEGCKKGKVLDGVRSFVDVGGSTGVAARAVAKAFPWVKCAVFDLPHVIATAPECPGVERIAGDMFASVPETDVVFMKSVLHDWGDEDCVKILKKCKEAIGGKKEGKVVILDIVLDAKSSNEFEGARLGMDMDMLVTVGGKERSEEEWKKLFKDSGYSHYKITPIVAIESIIELFP

SEQ ID NO: 510 - protein, 348 aa, Thalictrum flavum
MAAFQGKDESVDINAQAHVWKIIYGFADSLVLRCAVELGIFDIIDNNNQPITLADLASKLPISNVNLDNLFRILRYLVKMEILSYAGVNKYALEPIAKLVLRNEKRSMVPMVLGMTQKDFMTPWHSMKDGLTDNGVTAFEKAMGMTIWEYLEGHPDQSQLFNEGMAGETRLLTSSLISGSKDLFQSIDAVVDVGGGNGTTIKAISDAFPHIKCTLFDLPHVIANSYDHPNIERIGGDMFKGMPSAQAILLKLILHDWNDEDSIKILKQCRKAVPKDGGRVIIVDVALDEDSDHELSSTRLILDIDMLVNTGGKERTKEDWEKLVKCAGFSGCKIRHIAAIQSVIEIFP

SEQ ID NO: 511 - protein, 341 aa, Thalictrum flavum
MEDLSSQAKLWNYIYGFADSLVLKCAVQLDLANLIHDHGTPMTLSELSSRLPSQPVNQDALYRVMRYLVHIKLFTKSSIDGELRYGLAPPAKFLVKGWDNCMIGSILLMVDTDFMALYHYIKDEILNDGSSITITAFEKALGTNIWEYLAEHPEKNQLFNEGMANESRLYCSSTFEGLTTLVDVGGGTGTTVKYIAKAFPNIKYTVYDLPHVIADAPGDTEINFVQGDMFKYIPNADAILMKGVLHDWDDNECIEILKRCKHAVPRDGGKVIIIDVVLNVKSEHPYTKMRLTLDLDMMLNNKGKERTEEDWKKLIYDDAGYKGYKITQISALQSVIEAYPY

SEQ ID NO: 512 - protein, 350 aa, Xanthoriza simplicissima
MAFHGKDDALDIKAQAHVWKIIYGFADSLVLRCAVELGIVDIIDNNNQPIALADLASKLPVSNVNCDNLYRILRYLVKMEILRLENSDDGEKKYALEPIATLLSRNAKRSMVPMILGMTQKDFMTPWHSMKDGLSDDGTAFEKAMGMTIWEYLEGHPDQSQLFNEGMAGETRLLTSSLISGSRDMFQGIDSLVDVGGGNGTTIKAISDAFPHIKCTLFDLPHVIANSYDHPNIERIGGDMFKSVPSAQAILLKLILHDWNDEDSIKILKQCRNAVPKDGGKVIIVDVALDEESDHELSSTRLILDIDMLVNTGGKERTKEVWEKIVKSAGFSGCKIRHIAAIQSVIEVFP

SEQ ID NO: 513 - protein, 354 aa, Xanthoriza simplicissima
EIIKGDGTKEVLEAQAHIWNYTFNYITSMSLRCAVQLGIPDIIDNHDKPVTLSELVKALSFPQVKSAHVYRLMRVLVHSGFFTVGKIHEQEEEYMLTPSSKLLMKNHVTNLAPFLLMITDPVIANSCHFMTSLFQGSEVLPIEVAHGMSLWNYCNQHPEFNQLFNDAMASDTNFVLSVVVKEYKAIFEGFRSLVDVGGGIGTAAKAISKALPHLRCTVLDLPHVVSNMVGNANIEFVSGDMFKYVPPADIVLLKWIMHDWNDEECVKILQRCREALPAKEKGGKVIIIDVVVDCNKGKFETTEAQLCFDILMMVCLTGKERTEKEWEKLFMESGFTSYKITHGLGLRSIIEVFP

SEQ ID NO: 514 - DNA, 1380 bp, Argemone mexicana
atgagtgatatcatgaaggttgaagtagtatcaagagagataatcaaacccttatctccaacacccaatcaccttaaaaccttcaatttatcatttcttgatcaactttctcctccaatttatgtacccataattcttttctacccaattgactgtaaaaatgattgtaaatcaacaatcgaatcgattcgtggtaacctaaagaaaaccctagctcatactctaactaaatactatccattagctggaagaatcaaagatggtagctttgttgaatgtaatgatgatggtgtagactatgttgaagctaatgtatatgatattaatggtggaatctctgaaattatacaaaacccagatggagatatactgaaaaaattgcttccatttgatccttatggtgttgaaggatacaatactaaagtacttctctctatcagaatcaatgttcttgaagaaaactgtggtggaattgtgattggtatttgtatttcccataaaattggagatggatcttcattaactactttcattaatgattgggctgctgcagctcgaaaaaaccctagtgaacagatcaaaggtccccaatttgatttgccatctctattcccattaagagatttaaagggttatattcctccctcagctggtgcagaaatggtagaagaaattgtgacaaagaaatttgtgtttgaaggttctaagataactgaactcaagaaaaaaggtatcgttaatggcggaaacaatgatgacgatgacgttaagaagtacccgagtcgagttgaagcagtatcggctttcatttggagacgtgtgatcggtttagatcaagctaagaaacaaggtggtgattctaataatgaagctcctgtaacagtatatggatctttacatgcagtaaacatgagatcaaggatgaatccaccattaccatcaaattctttcggaaatatgtatactactacaatggcgttttccattattaataatcatgctgatgaggaagagaaattagggcattatcaattgccaaatttagtcgaaaaggttaaagaatcgataaagaaaatcgatagtgaatatgttaagaaagttcaaactactgatgaactattgaattctatgaaacacttagctacgggtcatcaaatggtgatgctaagttttagtagttggtgtaggtttccgatatatgaagccgattttggttggggaaaaccaatttgggtaacgacatctacgtttcctttcaagaatgtagttgttttcatggatactaaatcaggggacggaatagaagcgtgggtgaatatgactaaagatgatatggctgcgttcgagcgtgatcaagaactccttcaatatgtttcttaa

SEQ ID NO: 515 - protein, 354 aa, Papaver somniferum
MGSSIDAETHEVDIKDQAQLWNIIYGYADSLVLRCTVEIGIADIIKNNNGSITLSELVSKLPLSNVNSDNLYRLLRYLVHLNILGQQTCAAGVDRVYSLKPVGTLLLKDSERSMAPVILGLSQKDFLFVWNFVKEGLGTGSTTAFEKAMGMDMWKYLEVNPNQSQLFDEGQAGETRLLTKTLLVDCRDTFQGMDSLVDVGGGNGTTIKAIHEAFPHIKCTLYDLPHVIANSDDHPNILKVPGDMFMSVPSAQVLLLKCVLHDWTDEHCVNILKKCKEAIPKETGKVIIVDVALEEESEHELTKARLILDIDMLVNTGGRERTAEDWENLLKRAGFRSHKIRPIRAIQSVIEAFP

SEQ ID NO: 516 - DNA, 1065 bp, Papaver somniferum
atgggtagtagtatagatgctgaaacacatgaagttgacatcaaagatcaagctcaattatggaatataatctatggttatgctgattctcttgttcttcgttgcacagtagagattggaatcgcagatattatcaaaaacaataatgggtcaatcacactttcagagcttgtatcgaaactaccactttcaaatgtgaattctgataatttgtacagacttctaagatacttagtacacctgaatatcttaggacaacaaacttgtgctgctggagttgatagggtttactcacttaaaccagttggcacattattattaaaagattctgaaagaagcatggcaccagtaatattaggcctgtcacaaaaagatttcttgtttgtatggaatttcgtgaaagaaggattaggcactggaagtacaacagcatttgagaaagcaatgggaatggatatgtggaagtatttagaagttaatcctaatcaaagtcagttgtttgatgaagggcaagctggagaaacaagacttttaactaaaactctacttgtagattgtagagatacttttcaaggtatggattcgcttgttgatgttggtggaggaaacggtacgacaattaaggcaatccatgaagcttttcctcatattaaatgtacgctttatgatcttcctcatgttattgctaactctgatgatcaccctaacatcctaaaagttcccggtgatatgttcatgtctgttccaagtgctcaagttctcttactcaagtgcgtcttgcatgactggactgatgaacactgcgtcaacattctaaagaaatgcaaagaagcaatcccgaaagagacagggaaagtgatcatagtggatgtagcacttgaagaagaatctgaacatgaacttacaaaggcaagattgattcttgatattgatatgttggtgaatacaggtggtagagagagaactgcagaggattgggaaaatttgctcaaacgtgcaggctttcggtctcataagatcagaccgattcgcgctattcagtctgtcattgaagctttcccatag

SEQ ID NO: 517 - protein, 357 aa, Papaver somniferum
MGSLDAKPAAATQEVSIKDQAQLWNIIYGFADSLVLRCAVEIGIADIIKNNDGAITLAQLAAKLPITNVSSDYLYRMVRYLVHLNIIEQETCNGGVEKVYSLKPVGTLLLRDAERSMVPMILGMTQKDFMVSWHFMKEGLGNGSTTAFEKGMGMDIWKYLEGNPDQSQLFNEGMAGETRLLTKTLIEDCRDTFQGLDSLVDIGGGNGTTIKAIYEAFPHIKCTLYDLPHVVANSHDLPNIEKVPGDMFKSVPSAQAILLKLILHDWTDEECVNILKKCKEAIPKETGKVIIVDVALEEESNHELTKTRLILDIDMLVNTGGRERTADDWENLLKRAGFRSHKIRPIRAIQSVIEAFP

SEQ ID NO: 518 - DNA, 1074 bp, Papaver somniferum
atgggtagtttagatgcaaaaccagctgctgcaacacaagaagtttccatcaaagatcaagctcaactatggaatataatctatggttttgctgattctcttgttcttcgctgcgcggtagagattggaatcgcggatattatcaaaaacaatgatggggcaatcacacttgcacaacttgcggcgaaactcccaattacaaatgtcagttctgattacttgtacagaatggtaagatacttggtacacctgaatatcatagaacaagaaacttgtaacggcggagttgagaaggtttactcgcttaaaccggtcggtactctacttttaagagatgcagaaagaagtatggtgccgatgatactaggcatgactcaaaaagatttcatggtttcatggcatttcatgaaagaaggtttaggaaatggaagtacgactgcatttgagaaaggtatggggatggatatatggaagtatttagaaggtaatcctgatcagagccagttgtttaatgaaggaatggctggagaaacaagacttttaactaaaacgctgatcgaagattgtagagatacttttcaaggtttggattctcttgttgatattggtggaggaaatggtacgacaatcaaggcaatctatgaagcttttcctcatatcaaatgtacactttatgatcttcctcatgttgttgccaactctcatgatctccctaacatcgaaaaagttcccggtgatatgttcaagtctgttcccagtgctcaggctatcttactcaagttgattttgcatgactggactgatgaagagtgtgtcaacatcctaaagaagtgcaaagaagcaataccgaaagagacagggaaagtgattatagtggatgtagcacttgaagaagaatccaaccatgaacttacaaagacaagattgattcttgatattgacatgttggtaaatactggtggtagagagagaactgcagatgattgggaaaatttgctcaaacgtgcaggctttcggtctcataagatcagacccattcgcgctattcagtcagtcattgaagccttcccttag

SEQ ID NO: 519 - protein, 346 aa, Papaver somniferum
METVSKIDQQNQAKIWKQIYGFAESLVLKCAVQLEIAETLHNNVKPMSLSELASKLPVAQPVNEDRLFRIMRYLVHMELFKIDATTQKYSLAPPAKYLLRGWEKSMVDSILCINDKDFLAPWHHLGDGLTGNCDAFEKALGKSIWVYMSVNPEKNQLFNAAMACDTRLVTSALANECKSIFSDGISTLVDVGGGTGTAVKAISKAFPDIKCTIYDLPHVIADSPEIPNITKISGDMFKSIPSADAIFMKCILHDWNDDECIQILKRCKEALPKGGKVIIVDVVIDMDSTHPYAKIRLTLDLDMMLNTGGKERTKEEWKTLFDAAGFASHKVTQISAVQSVIEAYPY

SEQ ID NO: 520 - DNA, 1041 bp, Papaver somniferum
  misc_feature (672)..(672): n is a, c, g, or t
atggaaacagtaagcaagattgatcaacaaaaccaagcaaaaatctggaaacaaatttacggtttcgcagaatcactagttctgaaatgtgcagtccaactagagattgctgaaacacttcacaacaatgtcaaacccatgtctttatccgaattggcatcgaaacttcccgttgctcaacccgttaacgaagaccgtctgttccgaattatgcgttacttggttcacatggagctcttcaaaatagatgctaccacgcagaaatactcattagctccaccagctaagtatttgttgagaggctgggagaaatcaatggttgattcaattttatgcataaatgataaggatttcttagctccatggcaccatttaggcgacggtttgaccggtaactgtgacgcttttgagaaagcgttggggaagagtatttgggtgtatatgagtgtaaatcctgaaaagaatcaattgtttaatgcagcaatggcttgtgatactagattggttacttctgcattggctaatgagtgcaaaagtattttcagtgatggaatcagtacactggttgatgtcggcggtggtacgggtactgcagtgaaagccatatctaaagcttttccggatattaagtgcactatctatgatcttcctcatgtcatagctgattctccngaaatccccaatatcactaaaatttctggagatatgttcaagtctattcctagtgctgatgccatcttcatgaagtgcatacttcacgactggaacgatgacgaatgcattcaaatcttgaagagatgcaaagaagcattaccaaaaggtggcaaagttattatcgtggatgtcgtgatagacatggattcgactcatccatatgcaaaaattagactcacactggatttggatatgatgcttaacactggtggaaaagagagaaccaaagaagaatggaagacactttttgatgccgctggttttgctagccacaaagtcactcagatatctgctgtccaatctgtaattgaggcttacccttattaa

SEQ ID NO: 521 - protein, 357 aa, Papaver somniferum
MEVVSQIDQENQAIIWKQIYGFSESLLLKCAVQCEIAETIHNHGTPMSILELAAKLPIDQPVNIDRLYRVMRYLVHQKLFNKEVISTLNGGTVQVTEKYWLAPPAKYLIRGSQQSMVPSVLGIIDEDMFAPWHILKDSLTGECNIFETALGKSISVYMSENPEMNQISNGAMAFDSGLVTSHLVNECKSVFGDEIKTLVDVGGGTGTALRAISKAFPNIKCTLFDLPHVIADSPEIPTITKVSGDMFKSIPSADAIFMKNILHDWNDDECIQILKRCKDVVSAGGKLIMVEMVLDEDSFHPYSKLRLTSDIDMMVNNGGKERTEKEWEKLFDAAGFASCKFTQMSVGFAAQSIIEVY

SEQ ID NO: 522 - DNA, 1074 bp, Papaver somniferum
atggaagtagttagccagattgatcaagaaaatcaagcaataatctggaaacaaatttatggtttttcggaatcattacttctcaaatgtgcagttcaatgtgagattgctgaaactattcataaccatggaacaccaatgtctatattggaattagctgctaagcttccaattgatcaaccggttaatatcgaccgtttgtaccgagttatgcgttacttagttcaccagaaacttttcaacaaggaagttatctccacgcttaatggtggaaccgttcaagtaacagagaagtactggttagctccaccggcgaaatacctaataagagggtctcaacaatcaatggttccttcagttttaggaataattgatgaagatatgtttgctccgtggcatattctaaaagacagtttaactggtgaatgtaacatttttgagacagcgttaggaaagagcatttcggtttatatgagtgaaaatcctgaaatgaatcaaatttccaatggagcaatggcttttgatagtggattagttacttcgcatttggttaatgaatgcaaaagtgttttcggtgatgaaattaaaacattagttgatgttggtggtggtactggtactgcactcagagcaatttcgaaagcgttccccaatattaagtgcacactctttgatcttcctcatgttatagctgattcacctgaaattccaactattacaaaagtatcgggagacatgttcaagtctattccaagtgctgatgccatatttatgaagaacatccttcacgattggaacgatgatgaatgcattcaaattctaaagcgatgcaaagatgtagtatcagcgggagggaaacttattatggttgaaatggtattggacgaggattcgtttcatccatattcaaaacttagactcacatctgatatagatatgatggttaacaatggaggtaaagagagaaccgaaaaagaatgggaaaagctttttgatgcagcaggttttgctagttgcaaatttactcaaatgtcagtaggtttcgcagctcaatctataattgaggtttattga

SEQ ID NO: 523 - protein, 346 aa, Papaver somniferum
METVSKIDQQNQAKIWKQIYGFAESLVLKCAVQLEIAETLHNNVKPMSLSELASKLPVAQPVNEDRLFRIMRYLVHMELFKIDATTQKYSLAPPAKYLLRGWEKSMVDSILCINDKDFLAPWHHLGDGLTGNCDAFEKALGKSIWVYMSENPEKNQLFNAAMACDTRLVTSALANECKSIFSDGISTLVDVGGGTGTAVKAISKAFPDIKCTIYDLPHVIADSPEIPNITKISGDMFKSIPSADAIFMKCILHDWNDDECIQILKRCKEALPKGGKVIIVDVVIDMDSTHPYAKIRLTLDLDMMLNTGGKERTKEEWKTLFDAAGFASHKVTQISAVQSVIEAYPY

SEQ ID NO: 524 - DNA, 1041 bp, Papaver somniferum
atggaaacagtaagcaagattgatcaacaaaaccaagcaaaaatctggaaacaaatttacggtttcgcagaatcactagttctgaaatgtgcagtccaactagagattgctgaaacacttcacaacaatgtcaaacccatgtctttatccgaattggcatcgaaacttcccgttgctcaacccgttaacgaagaccgtctgttccgaattatgcgttacttggttcacatggagctcttcaaaatagatgctaccacgcagaaatactcattagctccaccagctaagtatttgttgagaggctgggagaaatcaatggttgattcaattttatgcataaatgataaggatttcttagctccatggcaccatttaggcgacggtttgaccggtaactgtgacgcttttgagaaagcgttggggaagagtatttgggtgtatatgagtgaaaatcctgaaaagaatcaattgtttaatgcagcaatggcttgtgatactagattggttacttctgcattggctaatgagtgcaaaagtattttcagtgatggaatcagtacactggttgatgtcggcggtggtacgggtactgcagtgaaagccatatctaaagcttttccggatattaagtgcactatctatgatcttcctcatgtcatagctgattctcctgaaatccccaatatcactaaaatttctggagatatgttcaagtctattcctagtgctgatgccatcttcatgaagtgcatacttcatgactggaacgatgacgaatgcattcaaatcttgaagagatgcaaagaagcattaccaaaaggtggcaaagttattatcgtggatgtcgtgatagacatggattcgactcatccatatgcaaaaattagactcacactggatttggatatgatgcttaacactggtggaaaagagagaaccaaagaagaatggaagacactttttgatgccgctggttttgctagccacaaagtcactcagatatctgctgtccaatctgtaattgaggcttacccttattaa

SEQ ID NO: 525 - protein, 354 aa, Papaver somniferum
MEIKLEDQEQEMRNQGHVWNIICGSVDSSVLKCTIELGILDTIHNSSKPMTLSSLSSASPSLSTLKAENLYRMLRYLSHMNLIAVNAAEGDETFSLTGISKLLLKNQERSLKDWVLGIDDEHSINGWHELTDYCLSADDAPTPFVKLHGKTIWELAEEVPEVNALINNAMACDTRMVMPAFVQGCDIILKGIKKLVDIGGGTGAAMSYIVKAFPEIKCMAFDLPHVVAAAPEVPGVEMVGGDMFESIPPADALLLKFMLHNWKDAECMKLLKRCKETIPANNGKVIIIEMVLDQDEGDDDLTQARLSLDLDMMLSSGGKERTKDEWRILLEEAGFNKIEFIPIFAIQSVIVAYA

SEQ ID NO: 526 - DNA, 1065 bp, Papaver somniferum
atggaaatcaaactagaagatcaagaacaagaaatgagaaaccaaggtcatgtttggaacataatctgtggtagtgttgattcatcagtacttaaatgtactattgagttaggcattcttgatacaattcacaattcatccaaacccatgacattatcttccttatcatcagcatcaccatctttatctacactcaaagctgaaaacttgtacagaatgttaaggtacttatctcatatgaatcttattgcagtgaatgcagctgaaggagatgagacattttctttaacaggtatatctaaattactgcttaagaatcaagaaagaagtttgaaagattgggttctcggtattgatgatgagcattcgattaacgggtggcatgagctaactgattattgtttatccgcggatgatgcgccaactccttttgtgaagttgcacgggaagaccatatgggaattagctgaagaagttcctgaagttaatgcacttattaacaatgccatggcttgcgatactaggatggtgatgcctgcatttgtacaaggttgtgatattatcttgaagggcattaaaaagttggtagatattggtggtggtaccggtgctgcaatgagttatattgttaaggctttccctgagattaaatgtatggcttttgatttgcctcatgttgttgctgctgcaccggaggttccaggtgtggaaatggttggtggcgacatgtttgaatccatcccccctgctgatgctcttttattgaagtttatgctgcataactggaaagacgccgagtgcatgaaactactgaagaggtgtaaggagacaattcctgcaaataatgggaaagttatcataatagaaatggttttggatcaagacgaaggtgatgatgatttgacacaagctagattaagtcttgatctagatatgatgttgagttcaggagggaaagaaaggactaaagatgaatggagaattttacttgaagaagcaggtttcaataagattgaattcattcctatttttgctattcaatcggttattgtcgcatatgcctag

SEQ ID NO: 527 - protein, 352 aa, Papaver somniferum
MEIQLQDQEQEMQYQGQIWNHICGNVDTQVLKCAIKLGVFDTIQNSDKSMLDLTEMSSSLSLSPIKPENLYRLLRYLTHMNLVTLTSVEGTEKFSLTDLSKLLLGNQEKSLKDWALGIGHEEGMGVWHELSSSCSMLAGGPTPWEMVFGEGCYEYTDKELGDTFNKAMSSDTRLAMPAVIRGCGKILSGLNSLVDVGGGNGTAMSYVVKAFPHVKCTVFDLPKVVERAQECHGVEFIGGDMFTSIPPADAVFLKFMLHNWGEAESINILRKCKEAIPADKGMVIIMDIVLDQDDEDDIDIVRAKLSLDLDMMCIGGRERTKEEWKNLLEISGFTRHEFLPIVAIQSIIVAYP

SEQ ID NO: 528 - DNA, 1059 bp, Papaver somniferum
atggaaattcaactgcaagatcaagaacaagagatgcagtaccaaggtcagatatggaatcatatttgtggaaatgttgatacacaagttcttaaatgtgcaattaaattaggtgtttttgataccattcagaactctgataagtccatgttagacttaaccgagatgtcaagctcattatctttatctccaatcaaacccgaaaacttatatcgactactaagatacttgactcatatgaatcttgttacccttacttcagttgaaggaactgaaaagttttcattaaccgacttatccaagttactacttggaaatcaagaaaagagtttgaaggactgggcactaggcatcggccacgaagaggggatgggagtatggcacgaactaagcagctcttgctcgatgctggccggtgggccgacgccttgggagatggtttttggtgaaggttgttatgagtatacagataaagaactgggtgacacattcaacaaagctatgtctagtgataccagattggcaatgcctgcagtaatccgaggttgtggtaagattttgagtggacttaattcattagttgacgtcgggggtggtaatggtaccgctatgagttatgttgttaaggcatttcctcatgtgaaatgcacggttttcgatttacccaaagtcgttgagagggctcaggaatgccatggtgttgagtttattggtggtgatatgtttacttcaatccctcctgctgatgctgtttttctaaagttcatgctacacaactggggagaggctgaaagtataaatatactgaggaagtgcaaggaagcaattccggcagataaaggtatggtgatcatcatggacatagtgctggatcaagatgacgaagatgatattgatatagtacgagcaaaattgagcctcgatctggatatgatgtgtataggaggtagggaaaggactaaagaagagtggaaaaatctacttgagatatctggctttacgaggcatgaattccttccaattgttgccatacagtcgatcattgttgcgtatccttaa

SEQ ID NO: 529 - protein, 355 aa, Papaver somniferum
MDIAEERLKGQAEIWEQMFAFVDSMALKCAVELGIPDIINSHGRPVTMSEIINSFKTTTSSSSSPNVEYLTRVMRLLVHNRVFSSQFHQESNETLYGLTRSSKWLLKDSEFNVSTLVLFETDPILLKPWQYLGECVQEGGFPFEKAYGCKIWEFALANPQFNEFLNSALRCTTSTIINEMLVEYKDGFNSIKSLVDVGGGTGTMMAQIVEANPHIEGINFDLPHVVATAPDYPGVKHVGGDMFVDIPEADAIMMKSVLHDWNDEYCAMILKSCYKALAKKKNGKVVLVEGVLQPNSNDTFDKTGLMFDMVMIAHTSAGKERTEEEWKILLNNAGFPRYNIIKTSAFHCIIEAFPE

SEQ ID NO: 530 - DNA, 1068 bp, Papaver somniferum
atggatattgcagaagaaaggttgaaagggcaagctgaaatatgggagcaaatgtttgcatttgtggattcaatggcattgaaatgcgctgttgaacttggtatacccgatatcataaactctcatggccgtccggtcactatgtcggagatcatcaacagcttcaaaacaaccacatcatcatcatcatctccgaacgttgaatatcttacgcgtgtaatgagattattggttcataaccgtgtattctcttcccaatttcaccaagaaagcaatgaaaccttgtatggtttaactcgctcgtcaaaatggttattgaaagattctgaatttaatgtgtcgacattggttttattcgaaactgatccgatattattaaaaccatggcaatatttgggtgaatgtgttcaagaaggtggttttccttttgaaaaagcttatgggtgcaagatttgggagtttgctttagctaaccctcaatttaatgagtttttgaatagtgcactgcgatgtacaacttcaacaataatcaacgagatgctagtcgaatataaagatggattcaacagcataaaatcgcttgttgatgtcggtggtggtactgggaccatgatggctcaaatagttgaggctaatccacatatagaaggtatcaattttgatttaccacatgtggtggctacagcacctgattacccaggggttaagcatgttggtggtgatatgtttgttgatatcccggaagctgacgctatcatgatgaagtcggtattgcacgactggaacgatgaatactgcgcaatgattttgaagagttgttataaagcattagcaaagaagaaaaatgggaaagtcgtacttgttgaaggtgtattgcaaccaaatagtaacgatacatttgataaaacaggattgatgtttgatatggtgatgatagcacatacttcagccggaaaagaaagaactgaagaagaatggaagatactattgaataatgctggtttccctcggtataatatcatcaaaacttctgcatttcattgtattatcgaggcttttccagaataa

SEQ ID NO: 531 - protein, 355 aa, Papaver somniferum
MDIAEERLKGQAEIWEQMFAFVDSMALKCAVELGIPDIINSHGRPVTMSEIINSFKTTTSSSSSPNVEYLTRVMRLLVHNRVFSSQFHQESNETLYGLTRSSKWLLKDSEFNVSTLVLFETDPILLKPWQYLGECVQEGGFPFEKAYGCKIWEFALANPQFNEFLNSALRCTTSTIINEMLVEYKDGFNSIKSLVDVGGGTGSIIAEIVKAHPHIQGINFDLPHVVATAAEFPGVKHVGGDMFVDIPEADAVIMKWILHDWSDEDCTIILKNCYRAIRKKKNGKVIIVDCVLRPDGNDLFDKLGLIFDVLMMAHTTAGKERTEAEWKILLNNAGFPRYNVIRTPAFPCIIEAFPE

SEQ ID NO: 532 - DNA, 1068 bp, Papaver somniferum
atggatattgcagaagaaaggttgaaagggcaagctgaaatatgggagcaaatgtttgcatttgtggattcaatggcattgaaatgcgctgttgaacttggtatacccgatatcataaactctcatggccgtccggtcactatgtcggagatcatcaacagcttcaaaacaaccacatcatcatcatcatctccgaacgttgaatatcttacgcgtgtaatgagattattggttcataaccgtgtattctcttcccaatttcaccaagaaagcaatgaaaccttgtatggtttaactcgctcgtcaaaatggttattgaaagattctgaatttaatgtgtcgacattggttttattcgaaactgatccgatattattaaaaccatggcaatatttgggtgaatgtgttcaagaaggtggttttccttttgaaaaagcttatgggtgcaagatttgggagtttgctttagctaaccctcaatttaatgagtttttgaatagtgcactgcgatgtacaacttcaacaataatcaacgagatgctagtcgaatataaagatggattcaacagcataaaatcgcttgttgatgtcggtggtgggaccgggtcgataatcgctgaaatagttaaggctcatccacacatacaaggcatcaattttgatctaccacatgtagtggctacagcggctgaatttccaggggtgaagcatgtcggtggtgatatgtttgtcgatattccggaagctgatgctgtcatcatgaagtggatattgcacgactggagtgacgaagactgtacaattatactgaagaattgttaccgagcaataagaaagaagaaaaacggaaaagtcataattgttgattgtgtgttgcgaccagatggaaatgacttattcgataaattgggattgatatttgatgtgctgatgatggcacatactacagctggaaaagaaagaacagaagcggaatggaagatcttattaaataatgcaggttttcctcgttacaatgtcattcgaactccggcatttccttgcatcatcgaggcctttccagaataa

SEQ ID NO: 533 - protein, 346 aa, Papaver somniferum
MEEAMDVHEQAHLWKLIYGFVDTLVVRSAVELGIFDIINNNLKPMTVLDLASKLPISNPCSDRLYRILRYLVHVRLLKVTDIDGLKRYSIQPVARFLLRDYDKSMAPIILGMTKKEFMSSWHHIKDGLSDDGSTAFDKAMGMSFFEYLEENPSQSKLFNEAMAGETRLLTASLINDCKDIFQGIESLVDIGGGNGTTIKAISDAFPHISCALFDLPHVVADSNDDHPNIKRVAGDMFESIPTSQAILLKLILHDWSDEDCVRILKRCREAVPKEGGKVIIVDVALEEESKHELNNPRLVLDIDMLVNTGGKERSREDWEKLTKLAGFGGYKIRHIAAIQSVIEITP

SEQ ID NO: 534 - DNA, 1041 bp, Papaver somniferum
atggaagaagccatggatgtccatgagcaagcacacctgtggaagctcatctacggcttcgtcgacaccttagtagtaaggtcggcggtggagctcggaatcttcgacatcatcaacaacaatttgaagcccatgacagtgctggacttggcctcaaagctccccatctccaacccctgttcggatcggttgtatcgaattcttcgatacctagttcatgtccgccttctcaaggtgaccgatatcgatggcctcaagcgctactcgatccaacccgtcgcgaggttcctactaagggactacgacaagagcatggcgcctatcattctgggcatgactaagaaggagttcatgtcttcatggcaccacattaaggatggattgagcgacgacgggagcaccgccttcgacaaggccatggggatgagcttcttcgagtacttggaggagaaccccagccagagcaagctcttcaatgaggccatggcgggggagactaggcttctcactgcttccctcatcaatgactgcaaagacatctttcaaggaattgagtccctggttgatatagggggaggaaatggcaccaccattaaggccatttccgatgcgtttccgcacatcagttgcgccctcttcgacctccctcatgtcgtcgctgactccaacgatgatcacccgaatattaaacgcgtcgctggagacatgttcgagtccatccctacctcccaagccatcttgctcaagttgattttgcacgattggagcgacgaagattgcgttcggattctaaagcgatgcagggaggcggtgccgaaggaaggggggaaggtgatcatagtggatgtggcattagaagaggagtccaagcatgagctgaacaatccaaggttggttttagacattgatatgttggtgaacactggagggaaagagaggagcagagaggattgggagaagctcaccaaactagcagggtttggagggtacaagattaggcacattgctgctatacaatcagtcattgaaatcactccttaa

SEQ ID NO: 535 - protein, 343 aa, Papaver somniferum; identical to SEQ ID NO: 483

SEQ ID NO: 536 - DNA, 1032 bp, Papaver somniferum; identical to SEQ ID NO: 443

SEQ ID NO: 537 - protein, 377 aa, Papaver somniferum
MTMNGNGHGQEHHAAAADYHVDVSYLSENANLGKLICIPMALRAAMELNVFQIFSKFGPDAKVSASELVSKIPKASGNPDAAMYLDRILRLLGASSILSVSTRMNSTGDHAVVPERLYGLTSASYCLVPREEDEVSLVPLLVLQSDKVIVDSFFKLKEMVMEKDVVPFDAAHGTSIFEYACKEPRLNKVFNEGMGAFSVVVFEAVFKYYDGFSGMKELLDVGGGIGTSIRKIVSKYRSVRGINFDLPHVISVAPQYPGVEHVEGDMFEEVPKAQNMLLKWILHDYDDERCVKLLKNCWNSLQVGGKVMIIEFVVPDRLVNNAESFNALNSDLIMMALNPGGKERTVSEFNDLADAAGFVKCVPFLISEGLHLIEFHK

SEQ ID NO: 538 - DNA, 1134 bp, Papaver somniferum
atgactatgaatgggaatggtcatggtcaagaacatcacgctgctgctgctgattaccacgttgatgtctcttacctttctgaaaatgcaaacttgggtaagttaatatgtattccaatggcactgagagctgcaatggagttaaacgtcttccagatattttcaaaattcgggccggacgcaaaggtttccgcttctgaattagtctctaaaataccgaaggcatccggtaaccctgacgcagccatgtatttagataggattctccgattactcggtgcaagctcaattctctctgtctctactagaatgaacagtaccggagatcatgcagtagtaccggagagactgtatggattaacgagtgcatcgtattgtttagtgcctcgagaagaagatgaagtttcgctagtaccactcttggtattgcaatctgataaggttatcgttgatagttttttcaaactgaaagagatggttatggagaaagatgtagtgccgtttgacgctgctcatggtactagcatcttcgagtatgcttgtaaagagccaaggttgaataaggttttcaacgagggaatgggagctttctccgttgttgtttttgaagctgtttttaagtattacgatgggttttctgggatgaaagagttgttagatgttggtggtggtatcggtacttctattagaaagattgtctcgaaataccgttccgttcgtggtatcaacttcgacttgcctcatgtcatttctgttgctcctcaataccctggtgtagagcatgtcgaaggagacatgtttgaagaagtccccaaggctcaaaacatgctgctcaaatggatacttcacgattatgacgatgaacgttgcgtgaagttgttgaagaactgctggaattcgttacaagtgggtggaaaagttatgataattgagtttgttgttcctgacagacttgtcaacaatgcagagtcgttcaacgcgttgaactctgatttgattatgatggctctgaatccaggcggtaaagaacggacagtttccgaatttaacgatttagccgatgcagctggattcgtgaagtgtgtacctttcttgatctctgaaggacttcatctcattgagtttcataaatga

SEQ ID NO: 539 - protein, 360 aa, Papaver somniferum
MGSIQNVDEDIQACRYAMELASASVPVMVLKTAIELDILEIIKKSGPGTQISVSEIVSQIQNLKNPDAPVMLDRMLRLLASYNILTCSLKDGGNDDKVERLYGLAPVCKFLTKNEAGCSMSALLLMNQDKVLMESWYHLKDAILDGGIPFNKAYGVHAFEYHGKDLRFNKVFNKGMSDHTTITMNKILETYKGFEGLNSIVDVGGGVGATVSMIISKYPTIQGINFDLPHVIQDAPSFPGIKHVGGDMFASVPNADAIFMKWILHDWSDEHSVKILKNCYDALPKNGKVIIVECIIPEVSDSSVAGHGVFHLDNIMLAHNPGGKERSLKQFENLAKDTGFTDFQVVCSAYDTYVMEFYKN

SEQ ID NO: 540 - DNA, 1083 bp, Papaver somniferum
atgggttcgatccagaacgtagacgaagatatacaagcatgtcgatatgctatggaattagccagtgcgtcagtaccagtgatggtgcttaaaacagccattgagctagacattcttgaaatcatcaagaaatcaggtcctggtacacagatcagtgttagtgaaattgtatctcaaatccagaatctcaagaacccagatgcgcctgttatgctggatcgtatgcttagattgttagccagttataacatcctcacttgcagtcttaaagatggggggaacgatgataaagttgaaagactttatggacttgctccagtctgtaaattcttgaccaagaatgaagctggttgttcaatgtctgctttacttcttatgaatcaagataaggtcctcatggaaagctggtaccatttgaaagatgcaatcctcgatggaggaattccctttaacaaagcttatggtgtgcacgcatttgaataccatggaaaagaccttaggttcaacaaggtatttaacaagggaatgtctgatcacacaaccatcaccatgaacaaaatccttgaaacctacaagggtttcgaaggtttgaactccattgtcgatgttggtggaggcgttggtgcaaccgttagtatgatcatctccaagtaccccacaattcaaggtattaacttcgacttacctcacgtaatccaagacgctccatcattcccaggcatcaagcacgtcggtggtgacatgtttgccagtgttccaaatgcagatgcaattttcatgaaatggattcttcacgattggagtgatgaacacagtgtcaaaatcttgaagaactgctacgatgcattacctaaaaatggaaaagtgattattgttgaatgcattataccagaagtgtcagacagtagcgttgcaggtcatggtgtattccatttggacaacattatgttggcgcataaccctggtggtaaagaaagatcactaaaacaatttgaaaacctggctaaagatactggattcactgattttcaagtggtctgttctgcttatgatacttacgttatggaattctacaaaaactag

SEQ ID NO: 541 - protein, 356 aa, Papaver somniferum
MGSSSIDVKPAETQEVSIKDQAQLWNMIYGFADSLVVRCAVELGIPDIIKNNNGPITLAQLSSKLPIPNVNSDHLYRIVRYLINLNILQQEICRNVKVYSLKPVGTLLLRDAERSMVPILLGNTQKDFLVPWHFVKEGLVNGSTTAFEKGMGMDIWKYLEGNPDQSQLFNEGMAGETSLLTKTLIEDCRDTFQNLDSLVDIGGGNGTTIKAIYEAFPHIKCTLYDLPHVISNSTDHPNIVKIPGDMFKSVPSAQAILLKLILHDWTDEQCVNILMRCKEAIHQETGKVIIVDVALEEESEHELTKTRLILDIDMMVNTGGRDRTAEDWENLLKRAGFRSHKIRPIRAIQSVIEAFP

SEQ ID NO: 542 - DNA, 1071 bp, Papaver somniferum
atgggaagtagcagtatagatgtgaaaccagctgaaacacaagaagttagcatcaaagatcaagctcaattatggaatatgatctacggttttgctgattctcttgttgttcgttgcgcagtagagcttggcattccagatattatcaaaaacaataacgggccaatcacacttgcacaactttcatcaaaactcccaattccgaatgtcaactcggatcacttgtacagaattgtaagatatttaataaacctgaatatcttacaacaagaaatttgtcgtaatgttaaggtctactcacttaaaccagttggtactttacttttaagagatgcagaaagaagtatggtgccaatattattaggcaatacacagaaagatttcttggttccatggcatttcgtgaaagaaggtttagtaaatggaagtacaacagcatttgagaaaggaatgggtatggatatatggaagtatttagaaggtaatccagatcaaagtcagttgtttaacgaaggaatggctggagaaacaagtcttttaactaaaactctaatcgaagattgtagagatactttccaaaatttggattctctagtcgatattggtggaggaaatggtacaacaattaaggcaatctatgaagcttttcctcatatcaaatgtacactttatgatcttcctcatgttattgctaactcaactgatcacccgaatatcgtaaaaatacccggtgatatgttcaagtctgttcccagtactcaagctatcttactcaagttgatcttgcatgactggactgatgaacaatgtgtcaacattctaataaggtgtaaagaagcaataaatcaagaaacagggaaagtgatcatagtagatgtagcacttgaagaagaatctgaacatgaacttacaaagacaagattgattcttgatattgatatgatggtgaatacaggtggtagagagaggactgcagatgattgggaaaatttgctcaaacgtgcaggctttcggtctcataagatcagacagattcgtgctattcagtctgtcattgaagccttcccatag

SEQ ID NO: 543 - protein, 358 aa, Papaver somniferum
MDIKLEDEEQEIKYQGHVWNMICGSVNSSVLKCTIVLGLFDTIHNSSKPMTLSSLSSASPSLSPLKTENLYRLLRYLSHMNLIVINSIQGSDDTFSLTDTSKLLLSNQERSLKDWVLGIDDPLAINGWHELTDYCLSPVDAPVPFVKMHGKTMWEFAADIPEVNELINNSMACDTKLVMPAFLQGCRGILNKGIVKKMVDIGGGTGAAMSYVVKAFPDIKCMVFDLPHVVANAPEIEGVELVGGDMFEFIPPADALLLKFILHNWDDVGCIQLLKKCKETISAEHGKVIIIEMVLEEDDQDNDALAQARLSLDLDMMVCSGGRERTKDEWRILVEEAGFSKIEFISIFAIQSVIVAYP

SEQ ID NO: 544 - DNA, 1077 bp, Papaver somniferum
atggatatcaaattagaagatgaagaacaagaaataaaataccaaggtcatgtttggaacatgatctgcggtagtgtgaattcatccgtacttaaatgtacgattgttttaggtcttttcgatacaattcataattcatccaaacccatgaccctatcctccctatcatcagcatcaccatctttatctcctctcaaaaccgaaaacttatatagactattaagatacttatctcatatgaatctcatcgtaatcaattcaattcaaggaagtgatgatacattttcattaacagatacatctaagttactacttagtaatcaagaaagaagtttgaaggattgggttcttggtatcgacgatccactcgcaattaacgggtggcatgagttaactgattattgtttatcccccgttgatgcgccggttccttttgtaaagatgcacgggaaaaccatgtgggagtttgctgcagatatccctgaagttaatgagctaatcaataactccatggcttgtgatactaaattagtaatgcctgcatttttgcaaggttgccgtggtatcttgaataaaggtattgttaagaagatggttgacatcggtggtggtacaggtgctgctatgagttatgttgttaaggcttttcctgacataaaatgtatggtttttgatttgcctcatgttgttgctaacgcaccggagattgaaggtgtggaattggttggtggtgatatgtttgaattcatccctcctgctgatgctcttttgttgaagttcattctccataactgggatgatgtcggatgcatacagctactaaagaagtgcaaggagacaatttcagctgagcatgggaaagttatcataatagaaatggttttggaagaagacgaccaagacaatgatgctttggcacaagcaagattaagtcttgatttagatatgatggtatgttcaggaggaagagaaaggacgaaagatgaatggagaattttagtggaagaggctggtttcagtaagattgaattcatttctatttttgccattcaatcagttattgttgcatatccataa

SEQ ID NO: 545 - protein, 375 aa, Papaver somniferum
MGSGHHSKHKGDHHEEEHSKDKQEEQACMFALQLASASVPVMVLRAAIEMDVLEIMNRAGPGSELSAAYIASQILNVTNPNASVMLDRMLRLLASYKILTCSDRTLDDGTTERVYGLELVCKFLVKDDDGVSMAPLLLMNQDKILLESWFHLKDAVVTGGIPFNLAYGMNAFEYPATDARFNTVFNKGMSDHTAIFMKKILETYKGFEGINSIVDVGGGVGVSLDMILTKYPSMKGINFDLPHVIKDAPAYESAVEHVGGDMFVSVPKGTDAVFMKWILHDWSDEFCTKVLKNIHDALPEYGKLILVECIIPSTTEPTLEALGVYHVDNMMMAYNPGGKERTEKEFDALAKATGFSGVKLICSAFNTWIMECHKN

SEQ ID NO: 546 - DNA, 1128 bp, Papaver somniferum
atgggttcaggccatcacagcaaacacaaaggtgatcatcatgaagaagaacattctaaagataaacaagaagaacaagcatgtatgttcgcattacaattggctagtgcatcagtaccagtgatggtattaagagctgcaattgaaatggatgttttggagataatgaacagagctggtccaggttctgagcttagcgctgcatatattgcatcacagattctcaatgttacgaacccgaatgctagtgttatgcttgaccgtatgttgagattattggctagttataagattcttacttgttctgatagaactcttgatgatggcacaactgagagagtctatggtcttgaacttgtttgcaagtttcttgtcaaggatgatgatggtgtttccatggctcctttgcttttgatgaaccaagataagatcttgttggagagctggttccatttgaaagacgcggttgtgaccggcggtatcccatttaacttggcatacggcatgaacgcattcgaatacccagcaacagatgcaaggttcaacacggtgttcaacaaaggaatgtcagaccacactgcaattttcatgaagaagattttagaaacgtacaaaggtttcgaaggtataaattcaatcgtcgacgttggtggtggtgttggtgtcagtctagacatgattcttacaaaatacccatccatgaaaggtattaacttcgatttaccacacgtaatcaaagacgctccagcttacgaatccgcggtcgaacatgtcggaggagatatgtttgtgagtgttccaaaaggaactgatgccgtattcatgaaatggattcttcatgactggagtgatgagttttgtaccaaagttttgaagaatattcatgatgctttacctgaatatggaaaattgatactagtggaatgcattattccgtcaacaactgaaccaactcttgaagctttaggtgtttaccatgttgataatatgatgatggcttataaccctggtggcaaagaaaggactgagaaagaatttgatgctttggctaaagcaactggattttctggggttaagctcatctgttctgcctttaacacttggattatggagtgccacaagaactaa

SEQ ID NO: 547 - protein, 355 aa, Papaver somniferum; identical to SEQ ID NO: 529

SEQ ID NO: 548 - DNA, 1068 bp, Papaver somniferum; identical to SEQ ID NO: 530

SEQ ID NO: 549 - protein, 376 aa, Papaver somniferum
MTMNGNGHGQEHHAAADYHVDVSYLSENANLGKLICIPMALRAAMELNVFQIFSKFGPDAKVSASELVSKIPKASGNPDAAMYLDRILRLLGASSILSVSTRMNSTGDHAVVPERLYGLTSASYCLVPREEDEVSLVPLLVLQSDKVIVDSFFKLKEMVMEKDVVPFDAAHGTSIFEYACKEPRLNKVFNEGMGAFSVVVFEAVFKYYDGFSGMKELLDVGGGIGTSISKIVSKYRSVRGINFDLPHVISVAPQYPGVEHVEGDMFEEVPKAQNMLLKWILHDYDDERCVKLLKNCWNSLQVGGKVMIIEFVVPDRLVNNAESFNALNSDLIMMALNPGGKERTVSEFNDLADAAGFVKCVPFLISEGLHLIEFHK

SEQ ID NO: 550 - DNA, 1131 bp, Papaver somniferum
atgactatgaatgggaatggtcatggtcaagaacatcacgctgctgctgattaccacgttgatgtctcttacctttctgaaaatgcaaacttgggtaagttaatatgtattccaatggcactgagagctgcaatggagttaaacgtcttccagatattttcaaaattcgggccggacgcaaaggtttccgcttctgaattagtctctaaaataccgaaggcatccggtaaccctgacgcagccatgtatttagataggattctccgattactcggtgcaagctcaattctctctgtctctactagaatgaacagtaccggagatcatgcagtagtaccggagagactgtatggattaacgagtgcatcgtattgtttagtgcctcgagaagaagatgaagtttcgctagtaccactcttggtattgcaatctgataaggttatcgttgatagttttttcaaactgaaagagatggttatggagaaagatgtagtgccgtttgacgctgctcatggtactagcatcttcgagtatgcttgtaaagagccaaggttgaataaggttttcaacgagggaatgggagctttctccgttgttgtttttgaagctgtttttaagtattacgatgggttttctgggatgaaagagttgttagatgttggtggtggtatcggtacttctattagtaagattgtctcgaaataccgttccgttcgtggtatcaacttcgacttgcctcatgtcatttctgttgctcctcaataccctggtgtagagcatgtcgaaggagacatgtttgaagaagtccccaaggctcaaaacatgctgctcaaatggatacttcacgattatgacgatgaacgttgcgtgaagttgttgaagaactgctggaattcgttacaagtgggtggaaaagttatgataattgagtttgttgttcctgacagacttgtcaacaatgcagagtcgttcaacgcgttgaactctgatttgattatgatggctctgaatccaggcggtaaagaacggacagtttccgaatttaacgatttagccgatgcagctggattcgtgaagtgtgtacctttcttgatctctgaaggacttcatctcattgagtttcataaatga

SEQ ID NO: 551 - protein, 291 aa, Papaver somniferum
MLDRMLRLLASYKILTCSDRTLDDGTTERVYGLELVCKFLVKDDDGVSMAPLLLMNQDKILLEIWFHLKDAVVTGGIPFNLAYGMNAFEYPATDARFNTVFNKGMSDHTAIFMKKILETYKGFEGINSIVDVGGGVGVSLDMILTKYPSMKGINFDLPHVIKDAPAYESAVEHVGGDMFVSVPKGTDAVFMKWILHDWSDEFCTKVLKNIHDALPEYGKLILVECIIPPTCEPTLEALGVYHVDNMMMAYNPGGKERTEKEFDALAKATGFSGVKLICSAFNTWIMECHKN

SEQ ID NO: 552 - DNA, 876 bp, Papaver somniferum
atgcttgaccgtatgttgagattattggctagttataagattcttacttgttctgatagaactcttgatgatggcacaactgagagagtctatggtcttgaacttgtttgcaagtttcttgtcaaggatgatgatggtgtttccatggctcctttgcttttgatgaaccaagataagatcttgttggagatctggttccatttgaaagacgcggttgtgaccggcggtatcccatttaacttggcatacggcatgaacgcattcgaatacccagcaacagatgcaaggttcaacacggtgttcaacaaaggaatgtcagaccacactgcaattttcatgaagaagattttagaaacgtacaaaggtttcgaaggtataaattcaatcgtcgacgttggtggtggtgttggtgtcagtctagacatgattcttacaaaatacccatccatgaaaggtattaacttcgatttaccacacgtaatcaaagacgctccagcttacgaatccgcggtcgaacatgtcggaggagatatgtttgtgagtgttccaaaaggaactgatgccgtattcatgaaatggattcttcatgactggagtgatgagttttgtaccaaagttttgaagaatattcatgatgctttacctgaatatggaaaattgatactagtggaatgcattattccaccaacatgtgaaccaactcttgaagctttaggtgtttaccatgttgataacatgatgatggcttataaccctggtggcaaagaaaggactgagaaagaatttgatgctttggctaaagcaactggattttctggggttaagctcatctgttctgcctttaacacttggattatggagtgccacaagaattaa

SEQ ID NO: 553 - protein, 358 aa, Papaver somniferum
MDIKLEDEEQEIKYQGHVWNMICGSVNSSVLKCTIVLGLFDTIHNSSKPMTLSSLSSASPSLSPLKTENLYRLLRYLSHMNLIVINSIQGSDDTFSLTDTSKLLLSNQERSLKDWVLGIDDPLAINGWHELTDYCLSPVDAPVPFVKMHGKTMWEFAADIPEVNELINNSMACDTKLVMPAFLQGCRGILNKGIVKKMVDIGGGTGAAMSYVVKAFPDIKCMVFDLPHVVANAPEIEGVELVGGDMFEFIPPADALLLKFILHNWDDVGCIKLLKKCKETISAEHGKVIIIEMVLEEDDQDNDALAQARLSLDLDMMVCSGGRERTKDEWRILVEEAGFSKIEFISIFAIQSVIVAYP

SEQ ID NO: 554 - DNA, 1077 bp, Papaver somniferum
atggatatcaaattagaagatgaagaacaagaaataaaataccaaggtcatgtttggaacatgatctgcggtagtgtgaattcatccgtacttaaatgtacgattgttttaggtcttttcgatacaattcataattcatccaaacccatgaccctatcctccctatcatcagcatcaccatctttatctcctctcaaaaccgaaaacttatatagactattaagatacttatctcatatgaatctcatcgtaatcaattcaattcaaggaagtgatgatacattttcattaacagatacatctaagttactacttagtaatcaagaaagaagtttgaaggattgggttcttggtatcgacgatccactcgcaattaacgggtggcatgagttaactgattattgtttatcccccgttgatgcgccggttccttttgtaaagatgcacgggaaaaccatgtgggagtttgctgcagatatccctgaagttaatgagctaatcaataactccatggcttgtgatactaaattagtaatgcctgcatttttgcaaggttgccgtggtatcttgaataaaggtattgttaagaagatggttgacatcggtggtggtacaggtgctgctatgagttatgttgttaaggcttttcctgacataaaatgtatggtttttgatttgcctcatgttgttgctaacgcaccggagattgaaggtgtggaattggttggtggtgatatgtttgaattcatccctcctgctgatgctcttttgttgaagttcattctccataactgggatgatgtcggatgcataaagctactaaagaagtgcaaggagacaatttcagctgagcatgggaaagttatcataatagaaatggttttggaagaagacgaccaagacaatgatgctttggcacaagcaagattaagtcttgatttagatatgatggtatgttcaggaggaagagaaaggacgaaagatgaatggagaattttagtggaagaggctggtttcagtaagattgaattcatttctatttttgccattcaatcagttattgttgcatatccataa

SEQ ID NO: 555 - protein, 362 aa, Papaver somniferum
MAISDPMEIKLEDQEQEMRNQGHVWNIICGSVDSSVLKCTIELGILDTIHNSSKPMTLSSLSSASPSLSTLKAENLYRLLRHLSHMNLIAVNSTEGNEIFSLTGISKLLLKNQERSLKDWVLGIDDEHSINGWHELTDYCLSADDAPTPFVKLHGKIMWELAEEVPEVNALINNAMACDTRMVMPAFVQGCDSILKGIKKLVDIGGGTGAAMSYVVKAYPEIKCMVFDLPHVVAAAPEIPGVEMVGGDMFESIPPADALLLKFMLHNWKDAECIKLLKRCKEAIPADQGKVIIIEMVLDQDEDDNDLTQARLSLDLDMMLSSGGKERTKDEWRILLEEAGLSKIEFIPIFAIQSVIVAYPLE

SEQ ID NO: 556 - DNA, 1089 bp, Papaver somniferum
atggcgatatcggatccaatggaaatcaaactagaagatcaagaacaagaaatgagaaaccaaggtcatgtatggaacataatctgtggtagtgtagattcatcagtacttaaatgtacaattgagttaggcattcttgatacaattcacaactcatccaaacccatgacattatcttccttatcatcagcatcaccatctttatctacactcaaagctgaaaacttgtacagattattgagacacttatctcatatgaatcttattgctgtcaattcaaccgaaggaaacgagatattttctttaacaggtatatctaaattactgcttaagaatcaagaaagaagtttgaaagattgggttctcggtatcgacgatgagcattccattaacgggtggcatgagttaaccgattattgtttatcggccgacgatgcacccactccttttgtgaagttgcacgggaagatcatgtgggaattagctgaagaagttcctgaagttaatgcacttattaataatgctatggcttgtgatactaggatggtaatgcctgcatttgtgcaaggttgtgatagtatcttgaagggtattaagaagttagtcgacatcggtggtggcaccggagctgctatgagttatgttgttaaggcttatcctgagataaagtgcatggtttttgacctgcctcacgttgttgctgctgcaccggagattccaggtgtggaaatggttggtggcgacatgtttgaatccattccccctgctgatgctcttttattgaagttcatgcttcataactggaaagacgcagaatgcataaaactactaaagaggtgtaaggaggcaattcctgccgatcaagggaaagttatcataatagaaatggttttggatcaagacgaagatgacaatgatttgacacaagctagattgagtcttgatctagatatgatgctgagttcaggaggaaaagaaaggaccaaagatgaatggagaattttacttgaagaagctggtttaagtaagattgaattcattcctatttttgctattcagtcggttattgtcgcatatcctctcgagtga

SEQ ID NO: 557 - protein, 360 aa, Papaver somniferum
MAISDPMGSIQNVDEDIQACRYAMELASASVPVMVLKTAIELDILEIIKKSGPGTQISVSEIVSQIQNLKNPDAPVMLDRMLRLLASYNILTCSLKDGGNDDKVERLYGLAPVCKFLTKNEAGCSMSALLLMNQDKVLMESWYHLKDAILDGGIPFNKAYGVHAFEYHGKDLRFNKVFNKGMSDHTTITMNKILETYKGFEGLNSIVDVGGGVGATVSMIISKYPTIQGINFDLPHVIQDAPSFPGIKHVGGDMFASVPNADAIFMKWILHDWSDEHSVKILKNCYDALPKNGKVIIVECIIPEVSDSSVAGHGVFHLDNIMLAHNPGGKERSLKQFENLAKDTGFTDFQVVCSAYDTYV

SEQ ID NO: 558 - DNA, 1107 bp, Papaver somniferum
atggcgatatcggatccaatgggttcgatccagaacgtagacgaagatatacaagcatgtcgatatgctatggaattagccagtgcgtcagtaccagtgatggtgcttaaaacagccattgagctagacattcttgaaatcatcaagaaatcaggtcctggtacacagatcagtgttagtgaaattgtatctcaaatccagaatctcaagaacccagatgcgcctgttatgctggatcgtatgcttagattgttagccagttataacatcctcacttgcagtcttaaagatggggggaacgatgataaagttgaaagactttatggacttgctccagtctgtaaattcttgaccaagaatgaagctggttgttcaatgtctgctttacttcttatgaatcaagataaggtcctcatggaaagctggtaccatttgaaagatgcaatcctcgatggaggaattccctttaacaaagcttatggtgtgcacgcatttgaataccatggaaaagaccttaggttcaacaaggtatttaacaagggaatgtctgatcacacaaccatcaccatgaacaaaatccttgaaacctacaagggtttcgaaggtttgaactccattgtcgatgttggtggaggcgttggtgcaaccgttagtatgatcatctccaagtaccccacaattcaaggtattaacttcgacttacctcacgtaatccaagacgctccatcattcccaggcatcaagcacgtcggtggtgacatgtttgccagtgttccaaatgcagatgcaattttcatgaaatggattcttcacgattggagtgatgaacacagtgtcaaaatcttgaagaactgctacgatgcattacctaaaaatggaaaagtgattattgttgaatgcattataccagaagtgtcagacagtagcgttgcaggtcatggtgtattccatttggacaacattatgttggcgcataaccctggtggtaaagaaagatcactaaaacaatttgaaaacctggctaaagatactggattcactgattttcaagtggtctgttctgcttatgatacttacgttatggaattctacaaaaacctcgagtga

SEQ ID NO: 559 - DNA, 1062 bp, Papaver bracteatum
atgggttcacaagcaactgaaacacaagttgttagcctcgaagatcaagctcaaatatggaatataatctatgggttcgctgattctcttgttcttcgttgcgcagtacagattggcattccagatattatcaaaaacaataaagggtcaatcacacttgcacaactttcatcaaaactcccaattccagatgtcaattctggtcacttacaaagaattataagatatttagtacagttggatatcttacaacaagaaacttgtaatggtggagctgaaatggtttactcacttaaaccagctggtactttacttttaagagatgcaaaaataagtatggtaccaatgctattaggtttgacccaaaaagacttcatggtaccgtggcatttcattaaagaagttttaggaaatggaagtgcaacagcattcgagataggcatgggtaagacaatgtggcagtatttagctgataatcctgaacaaagtcagttgtttgatgaaggaatggcgggagatataacacttttaagtaaaactctaactgaagattgcagtgatatttttcaaggtttagattctcttgttgatgttggtggaggaaatggtgcagcaattatggcaatctatgaagcttttcctcatataaaatgtacactttttgatcttcctcatgttattgctagctctcataatcaccctaagatcgaaaaaatacccggtgatatgtttaagtctgttcccagtgctcaagccctcttactcaagtcgatcctgcatgactggactgatgaagagtgtgtcaaaattctaaagaactgtaaagaagcaataccaaaagagacagggaaagtgattatagttgatatagcacttgaagaagaatctactcatccacttgccaaaaaaagattggttcttgatattgatatgttggtgaataccggtggcagagagagaactgcagacgattgggaaaatttgctcaaaagtgcaggctttcggtctcataagatctcacccattcgcgctatgcagtctgtcattgaagccttcccatag

SEQ ID NO: 560 - DNA, 1041 bp, Papaver bracteatum
atggaaacagtaagcaagattgatcaacaaaaccaagcaaaaatctggaaacaaatttacggttttgcagaatcactagttctgaaatgtgcagttcaactagagattgctgaaacacttcacaacaatgtcaaacccatgtctttatccgaattagcatccaaacttccggttgctcaacccgttaacgaagaccgtttgttccgaattatgcgttacttggttcacatggaactcttcaagatagacgctaccacgcagaaatactcattagctccaccagctaagtatttgttgagagggtgggagaaatcaatggttgattcaattttatgcataaatgataaggatttcttagctccgtggcatcatttaggtgacggtttaaccggtaactgtgacgcttttgagaaagcgttggggaagagtatttgggtttatatgagtgaaaatcctgaaaagaatcaattgtttaatgcagcaatggcttgtgatactagattggttacttctgcattggctaatgagtgcaaaagtattttcagtgacggaatcagaacactggtggatgtcggcggcggtaccggtactgctgtgaaaaccatatctaaagcttttccggatattaagtgcactatctatgatcttcctcatgtcatagctgattctcctgaaattcccaatattactaaaatttctggagatatgttcaagtctattcctagtgctgatgccatcttcatgaagtgcatacttcacgactggaatgatgaggaatgcattcaaatcttgaagcgatgcaaagaagcattaccaaaagatggcaaagttattatcgtggatgtcgtgatagacatggattcgactcatccatatgcaaaaattagactcacattggatttggatatgatgctcaacactggtggaaaagagagaaccaaagaagaatggaagatactttttgatgccgctggttttgcaagccacaaagtcactcagatatctgctgtccaatctgtaattgaggcttacccttattaa

SEQ ID NO: 561 - DNA, 1050 bp, Papaver bracteatum
atggaagtagtatacaaaattgatcaagaaaatcaagcgaaaatctggaaaatgatttatggtttttcggaatcattagttctcaaatgtgcagttcaactagagatcgcagaaactattcataaccatggaaaaccaatgtctttgtctgaattagcttctaaacttcccgttcaacctgtcaattcagatcgtttattccgtattatgcgttacttggttcacatgaaattattcaagatagaagtttcttcacttaatggtggaagtgcctactcgttagctccaccaggaaaatatttgataagaggctggggaaaatcgatggttgcttcgattttagcaatgaatgataacgatttgttagctccatggcatcatttaaatgaaggtttgactggtaattgtaacgctttcgagaaagcgttgggaaagagcatttgggtttatatgagtgaaaatcctgaaaagaaccaactttttaatgaagcaatggcgtgcgatactgaattagttaattcagctttggttaatgaatgcaaaagtgtattctgtaatggaactaaaaccttagttgacgttggcggtggtattggtgctgctatgatggcaatttcggaagctttcccgagtattaagtgcacaatctttgatcttccgcatgttatcgctgaatctcctgaaatgccaaatattacgaaaatttcaggtgatatgttcgagtctattccaagtgctgatgccatctttatgaagaacatccttcatgattggaacgatgataagtgcattcaaattttaaagcgatgcaaagaagcactaccacgaggagggaaagttattatcgttgatatagtactggatgttgctgattcggttaatccattttcaaaaattagacttgcgtccgatttggatatgatgcttaacactggagggagagagagaactgaaaaagaattgaagaaacttattgatgcctcaggttttgctagctacaagattactcaaatgtctgcagttcaatctgtgatcgaggtttatccttaa

SEQ ID NO: 562 - DNA, 1092 bp, Papaver bracteatum
ctgaattcgactagcaaagaggagattgagctgatacaagctcacactcatatctggaagtatgtattcagctatgcaaattccatgtctctcaaatgtgttgttgaattaggcatacccgacataatccacagccatggaaaacccatgactctgtctagtcttgttgatgctctctttcttccatcagcgagaatcgatcctttgaataggttaatgcgctttatgattcattcgggattctttgaaacacgaagccttggcgaaaatcaagaacaacagggatatatactaacaccaacttcaaggcttttagtaaaagctaatcccaagacgatgtcatctgttgttctctctatggtcgatcctatcatggtatcatcttttcaatccttacacacttggtttcagggaagtgaatcctcaccatttgtggctgctcatggtatgagcctatggaatttgttggagcagaatcccgagtctggcaagaacttccatgattcgatggctaatgactcttgcgtgttgatgagtgtaattcttaatgaaggcaagggggtattcaataacttgaagtctctggttgatgtaggaggtgggactggaactacagctcatgccgttgttggagcattcccacacctcaactgcatggttctcgacctcccaaatgttgttgcagacttacaagggactgctaatgtagtcttcattgggggtgacatgttcgagtccatccctcatgcagatgcagtcttactcaagtttattcttcatgattggagcgacaaagattgtgttcgaatacttaagatgtgcagagaagctattccgtcaacagaagagggaggaaaggtgataataatagatgccgtgattgaagaagacaagaagaagaaacaagaagctaaagacgattcaataattactgaaactcaactactgtttgacattatgatgatggcttttgttaatggtaaagagagaactgagaaagaatggaaaaaacttttcatcgactcaggttttaccgactacaaaataactcgtgtccaggggtttaggtccttcattgaggtttatccttaa

SEQ ID NO: 563 - DNA, 1062 bp, Papaver bracteatum
atggatgctgaagaagaaataacgaaagggcaggccgaaatatgggagcatatgtttgcattcgcagattcaatggcgttgaaatgtgcagttgaacttggtataccggatattatcaactctcatggtcatccggtcacagtgtttgagatcatcaacagtttaaaaacaaccacatcatcatcatctcccaacatcgattatcttactcgtgtgatgagattgttggtccgcaaaagtatttttacttctcattttcatcaagaaaccaatcaaatcttgtatggtttaactccttcatccaaatggttattaagagattccaaatttaatctatcaccaacgatttcattttttcttcatccttcaatattgaaaccatggcaatatctaggaaattgtaccaaagaaaatggtcttgcttttcagaaagctcatgggtgtgaaatctgggatatggcggcagctgatcctcatttcaatcaagttttcaatgatggaatgggatgcacggctaagatgatagttagccagatgttgaccgaatataaagatggatttaactgtattggatcgcttgttgatgttggcggtgggaaaggggcgatgatagcagcaattgttgaggctaatccacacataacaggtatcaattttgatctacctcatgtactggctactgcacaagaacatccaggggtcacccatgttacaggtgatatgtttgttgagattccggaagctgatgctgttataatgaagtggataatgcatgactggagtgatgaaaattgcgtcaagatcttgaaaaattgttataaggcaatatcaaagacgaagaatggaaaggttataattgttgattgtgtattgcaaccagaaggaaatggattatttgatgaaacaggagtggcatttgatctactgatgatggtaatcccaggaggaaaagaaagaactgaagtcgaatggaacaacttactgaaaagtgcaggcttccctcgttataatcttatacaaattcccacaatccattctatcattgaggcattcccagaatga

SEQ ID NO: 564 - DNA, 1059 bp, Papaver bracteatum
atggatactgcagaagaaagattgaaagggcaagctgaaatatgggagcatatgtttgcatttgtagattcaatggcattgaaatgtgcagttgaacttggtatccctgatattataaactctcacggtcgtccgatcacaatgtctgagattatcgactacttaaaaacaaacacatcatctctcaacgtcgattatcttacacgtgtcatgcgattattggtgcataagcgtctatttacttctcaacttcaccaagaaaacaatcaaattgtctatggtttaactcggtcgtcaaaatggctactcaaagattctaagtttaatctttcaccgttggttttattcgaaactagtcctcaaccattaaaaccatggcaatatttgggcaaatgcgttcaagaaaatggtttaccttttgagagtgctcatggatgcgggatttgggatcttgctttagctgatcctaaattcaatggaaaattgaatggagcaatgcaatgtatgactatcctgataatcaacgagatgttgactgaatataaaggtggattcaacggaataagatcgattgttgatgtcggtggtggaaccgggacgttgctagctgagatagttggggctaatccacacatacaaggtatcaattttgatctaccacatgtagtgactacatgccctgatatcctaggggttaagcatcttggtggagatatgttcgttagtattccagaagctgatgctgtcatcatgaagtcgcttttgcatgactggactgacgaagactgcacaaaaatcttgaaaaattgttataaggcaataacaaataagaaaaacggaaaagttataatagttgaatttgtgctgcgaccagaaggaaatggcttatttgataaaacaggattgatcttagatatggtgatgttggcacatacttcaggtggcaaagaaagaactgaagtcgaatggaagatgttattaagtaatgccggttttcctcgttataatatccttcaaactcctgcatgtccttgtatcatcgaggcatttccagaataa

SEQ ID NO: 565 - DNA, 1068 bp, Papaver bracteatum
atggatattgaagaagaaagattgaaggggcaagcagaaatatgggagcatatgtttgcatttgcaaattcaatggcattgaaatgtgcaattgaacttggtatgcccgatatcataaactcttatggtcgtccagtcacaatgtccgagatcataaacagtttaaaaaaaaccacattatcatcatctcccaatgtggattatcttactcgtgtaatgagattgttggttcataaacgtatttttgcttctcaatttcatcaagaaagcaatcagattttatatgatttaactccatcatcaaaatggttactaagagattctaaatctactctagcaccaatgattttacttcaccttcatcctctctttttaaaaccatggcaatatgtgggaaaaagtgttgaagaaagtggttttccttttgagaaagctcatggatgtgatgcttgggatctggctttagctaatcctcactttaatcagcttttcaacgatgggatggaatgctcggctaagatagcagtcaacaagatgttagccaactataaaggaggatttaatggtataggagtgcttgttgatgttggtggggggaccgggtcgatgattgccggcatcgtgaaagcgaatccacatattagaggtgtcaatttcgatctacctcatgtagtggctacggcacctgaacatccagggatcacccatgttgggggtgatatgtttgctgatattccagaaggtgatgctattatcatgaagtggataatgcatgattggagcgatgaagactgcataaagatcttaagaaactgctacaaggcaatatccaagacaaagaatgggaaagttataattgttgactgtgtactgcaaccagatcacggaaatggcttatttgatgaagcgggattattattcgatctactgatgatggtaaatacttcgggtggaaaagaaagaaccgaagtcgaatggaacatgttattgaacagtgcaggtttcactcgttacaacataattcaaattcccacattcccttctatcatcgaggcctttccagaatga

SEQ ID NO: 566 - DNA, 1065 bp, Papaver bracteatum
atggatactgcagaagaaagattgaaagggcaagctgaaatatgggagcatatgtttgcatttgtggattcaatggcattaaaatgtgcagttgagcttggcatacccgatataataaactctcatggtcatcctgtcacaatatctgaaatcatcgacagtttaaagaaaagcacatcaacatctcccaacatcgattaccttacacgtataatgagactattggttcacaagaagctatttacttctcaatttcatcaagaaagtaaccaaattgtctatgatttaactcgatcatcaaaatggctactaaaagattccaagtttaatctgtcaccgttggttttatgggaaaataatccgatattattaaagccatggcaatatttgggcaagtgtgtccaagaaaatagttctccttttgagagagctcatggatgtgagatttgggatcttgctttagcggatcctaaatttaataatttcctgaatggtgcaatgcgatgttcgactacaacaataatcaacgagatgttgcttgaatataaagatggatttagtggtatagcaggatcgcttgttgatgtcggtggtggaactgggtcgataattgctgaaatagttgaggctaatccacacatacaaggcatcaatttcgatctaccacatgtagtggctacggcgcctgaatttccaggggtgaagcatgtcggtggtgatatgtttgtcgatattccggaagctgatgctgtcatcatgaagtggacattgcatgactggagtgacgaagactgcacaatcatactgaagaattgttaccaagcaataagaaagaagaaaaacgggaaagtcataattgttgattgtgtattgcgaccggatggaaatgacttatttgataaaatgggattgatatttgatgtgctgatgatggcacacactacagctggaaaagaaagaacagaagcggaatggaagatcttattaaataatgcaggttttccccgttacaatgtcattcgaactccggcattttcttgcatcatcgaggcctttccagaataa

SEQ ID NO: 567 - DNA, 1062 bp, Papaver bracteatum
atggatactgcagaagaaagattgaaagggcaaattgaaatatgggagcttacgggagcagttatagattcaatggcattgagatgtgcagttgaacttggtataccagatattataaactctcatggtcgtccaatcactatttcagagattatcaacagtttaaaatcaaccaaggcatctccgaacgcagaatatcttacacgtgtaatgagattattggttcacaaccgtgtattcacttctcaagtccaccaagaaagtaatcaaattgtatacaatttaactcgatcgtcaaaatggctactgaaagattctaagtttaatctatcacctacagttctatttgatactcatccaataatagtaaagccatggcaatatttgggcagatgtgttcaagaaaatggttttccttttgagagagctcatggacgtgagatttgggatcttgcttcagctgatcctaaatttaataatctcctgaatggtgcaatggggtgtacaagtacaacgataattaacgagatgttactcggatataaagatggatttagtggtataggatcgcttgttgatgtcggtggtgggaccgggacgataatagcggagattgttgaggctaatccacacataataggtaccaacttcgacctaccacatgtggtggctacagcgcctgattttccaggaattaagcatgttggtggtgatatgtttgttaacattcctgaagctgatgctgtcctcatgaagtggatattgcacgattggagtgacgaagactgcacaaaaatattgaagaattgttataaagcaataaccaagaagaaaaatgggaaagtgataattgttgaatgcgtattgcgaccagggggaactggcttatttgataaaatagggttgatatttgatatggggatgttggcacttacttcaggtggaaaagaaagaacggaagatgaatggaagatgctactaaataatgcaggttttccccgctataatatcattcaaactccttcatgtgcttactgtatcatcgtggcctttccagaataa

SEQ ID NO: 568 - DNA, 1062 bp, Papaver bracteatum
atggatgccgaagaagaaagattaaaagggcaggcagaaatattggagcatatgtttgcatttgtagattcaatggcactgaaatgtgtagttgaactaggtatacccgatattattaactctcacagtcgtccagtcacaatgtctgagatcatcgacaatttaaaaacaaacaatttatcatcacccaatgtcgattatcttacgcgtgtgatgcgattcttggtccataagggtctattttcttctcaatttcaccaagaaagtaatcaagacgtctacaatttaactcgatcgtcaaaatggctactaaaagattctaagtttgatctatcaccgtttgttatagtcgaaacgaatccaatattacaaaagccatggcaatacttgggtaaatgcgttcaagaaaatggtttaccttttgagagagcttatggatgtgggatttgggaccttgctttaattgatcctaaattcaataataattttaattgtgcaatgcaatgtatgactatgatgatgataaacgagatgttgatcgaacacaaagatagatttaatggtataggattgctggttgatgttggtggtgggaccgggacgatgatcgcggagatagttaaagctaatcctcatatgcaaggtatgaactttgatctgccacatgtggtggctacagcgcctgatttcccaggggttaaacatgttggtggtgacatgttcattgatattccggaagctgatgctgtcatcatgaagttggtattgcatgactggacagacgaagattgtagaaaaatcttgaaaaactgttataatgcaataacaaacaagaaagatggaaaagttataattgtcgaatatgtattgcgaccagaagaaagtggcttatttgataaaacaggattgatattagacatggtgatgatggttcatacttcaggtggaaaagaaagaaacgaagtagaatggaaggtgttattgaataatgcaggttttcctcgttgtaatattttccagtctcctgcgtatatttgtttcatcgaggcatttccagaataa

SEQ ID NO: 569 - DNA, 1020 bp, Papaver bracteatum
atggaagtagtaaataagattgatcaagaaaaccaagcaaaaatttggaaacaaatatatggttttgcagaatcattagttctgaaatgtgcagttcagttacagattgctgaaacacttcataataatgtaaaacccatgtctttatccgacttagcatctaaacttcccgttcaacctgttaatgaagaccgtttataccgaattctgcgttacttagttcacatgaaactcttcaacaaaaatgctaccactcaaagatattcattagctccaccagcaaagtatttgctaagaggctgggaaaaatcaatggttgcttcaatattaagcgttacggataaagattttacagctccatggaaacatcttagtgacggtttaactggtaactgtaacgcttttgagaaagcgttaggaaagagtattcgggtttacatgagtgaaaatcctgaaaaaaatcaattgtttaatgaaggaatggcttgtgatactggattgtttacctcagcaatggttaatgagtgcaaaaatatcctcagtgacggaatcaatacactagccctggttggcggtggtgctggtactgcagtgaaagccatatctaaagcttttccggaaactaaatgcacaatccatgatcttccacaaattctcagtaacattaataaaacttccagagatttgttcaagtccgttcctagtgccgacgccatctttatgaagagcatccttcacgagtggaacgatgaggaatgtattcaaatcctgaagcgatgcaaagaagcggtaccaaatgggggcaaagttattatcgcagatgtcgtactagacatggattcgactcatccgtattcaaaatcgagactcgcaatggatttggatatgatgctccacaccggtggaaaagagagaactgaagaagattggaagaagcttattgatgctgcaggttttgctagctgtaaaattactaatctatctgctctccaatctgttattgaggcttaccctcattga

SEQ ID NO: 570 - DNA, 1065 bp, Papaver bracteatum
atggaaatcaaactagaagatcaagaacaagaaatgaaaaaccaaggtcatgtttggaacataatctgtggtagtgttgattcatctgtacttaaatgtacagttgaattaggcattcttgatacaattcatcattcatccaaacccatgacactatcttccttatcatcagcatcaccatctttatctacactcaaagccgaaaatttgtacagattattgagatacttatctcatatgaatcttattgctattgattcaactgaaggaaatgagacattttctttgacaggtttatctaaattactacttaagaatcaagaaagaagtttgaaagattgggttctcggtatcgacgatgagcattcgattaatgggtggcatgagttaagtgattattgtttatcggctactgatgcaccgactccatttgtgaaattgtatgggaaaactttatgggaatttgctgcagaagttcctgaagttaatgagctaattaataatgccatggcttgtgatactaggatggtgatgcctgcatttgtgcaaggttgtgacagtatattgaagagtgttaagaagttagttgatattggtggaggcaccggagctgcgatgagttatgttgttaaggcttatcctgagataaaatgtatggcttttgatttgcctcatgttgttgctgctgcaccggaggttccaggcgtggaaatggttggtggagacatgtttgatatcattccctctgctgatgctcttttattgaagttcatgctgcataactggaaagacgccgaatgcataaaactgctaaaaaggtgtaaggaaacaattcctgaagataatgggaaagttatcataatagagatggttttggatcaagatgaagatgatgatgttttgacacaagctagattaagtcttgatctagatatgatgttgagttcaggagggaaagaaaggactaaggatgaatggagaattttacttgaagaagctggtttcaataagattgaattcattcctatttttgctattcaatcagtcattgttgcatatccttag

SEQ ID NO: 571 - DNA, 1122 bp, Papaver bracteatum
atggcaactttgtcttcgaagataacagggcctgaacgagtccttgatgaagggattcatttcgaaagccaagaacaagaaatgaaatatcaagctcaaatttggaaccacatgtgtggtgttgttgatacctcagttctgaaatgtgcaattgaattaggtatatttgatgccattcataactcaagtaaaccggcaattaccttaaccgaattatcaagcgttatttcaagttcaacaccatctgcatcttcaatcgaaccccgcaacttatatagattaatgagatacctatctcaaatgaatctcataagtacagaaaaatgctcggatgaagtaactgtttcgttgacagacacatctaagttactacttagaaaccaagagaagagtttgattgattgggttctgggaatttccagcgaaccgtgcgtgcttgtttggcacgaactaagcagctctctttcaacccctgcggatggacctccaagcttcgagaaggttcacggtaaaaattgttatgaattagctggagaaaatccagagtggaatgaactgattaacaatggtatgactagtgataccagtttaactatgccggcatttatacaaggatgtgatagaatcctcaaaggaattacatcgttaattgacgtcggtggtggtactggtgcctctatggcttacgtcgttaaagcttttcctcacataaaatgtggggtattcgacttaccacatgttgttgaggccgctccgcagtgtcccggtgttgagttcatcggtggtgatgtttttaaattccttcctaatgctgatgctcttttgttgaagtacaccctgcacaattgggaagatccagaatgtgtggatttgctgaagagatgtaaggaagtaattccggcagacaacggaaaggtgatcataatggatttagtaatagaccaagatgataacgatactttgatgcaggcgaggttgagccttgatctcgatgtgttgaaccatggaggtagagaaaggactaaagaagactggagaaatctaattgagatgtctggatttagtaggcatgaaataattccaatatttgcaatgccatcagtgattgttgcttatccttag

SEQ ID NO: 572 - DNA, 1077 bp, Papaver bracteatum
atggatatcaaattagaagatgaagaacaagaaataaaataccaaggtcatgtttggaacatgatctgcggtagtgttaactcatccgtacttaaatgtacgattgttttaggtcttttcgatacaattcataattcatccaaacccatgacactatcctccctatcatcagcatcaccatctttatctcctctcaaaaccgaaaagttatatagactattaagatacttatctcatatgaatctcatcgccatcaattcagttcaaggaagtgatgatacattttcattaacagatacatctaagttactacttagtaatcaagaaagaagtttgaaggattgggttctcggtatcgacgatccactcgcaattaacgggtggcatgagttaagtgattattgtttatcccccgttgatgcgccggttccttttgtaaagatgcacgggaaaaccatgtgggagtttgctgcagaaattcccgaagttaatgagctattcaataactccatggcttgtgatactaaactagtaatgcctgcatttttgcaaggttgccatagtatcttcaataaaggtactgtaaaaaagatggttgacatcggtggtggtacaggtgctgctatgagttatgttgttaaggcttttcccgacataaaatgtatggtttttgatttgcctcatgttgttgctaacgcaccggagattcaaggtgtggaattggtgggtggtgatatgtttgaatttatccctcctgctgatgctcttttgttgaagttcattctccataactgggatgatgtcggatgcataaagctactaaagaagtgtaaggagacaatttcagctgatcatgggaaagttatcataatagaaatggttttggaagaagacgaccatgacaatgatgctttgacacaagcaagattgagtcttgatttagatatgatggtatgttcaggaggaagagaaaggactaaagatgaatggacaactttagtggaacaggctggtttcagcaagattgaattctttcctatttttgccattcaatcagttattgttgcatatccataa

SEQ ID NO: 573 - DNA, 1074 bp, Papaver bracteatum
atggaaattcaaatggaagatgaacaactagaaatgaaatatcaatctcaaatatggaatcacgtatgtggtagtgttaatacatcagttcttaaatgttcaattagtttaggcatttttgatgtcattcatgattcaggtaagtccatgttgactttaactgagttatcaaattcattatcatcttcaaacatgatcaaaacccacaacttatatagacttcttagatacttgagtcatatgaatcttattgccatcagttcgatccaaggaaatgatcatttttctttaactgatttatctaagttactacttggaaatcaagaaaagagtttaaaggattgggccatagggattggtgatgtaaattttgtggcaacttggcatgaaatgagtagctcttgttccaaactcccaggtgacctcacggcttgggaaacagtacatggtaaagagggttacgagttaaatgtggaggatccagaatttagtgaaaggtttgataaggctatgtcaagtgatactacattagctatgcctgcatttatccaaggttgtgatataattatgagtggaattagttcattagttgatgtcgggggtggaatcggtaccgctatgacttatgttgtcaaggcatttcctcatataaaatgtactgtttttgatgtaccccatgtgattcatacagcggcggatccagcaaagtgtcatggtattgagttcattggtggtgatcttttcagcttcatccctcctgctgatgctattttgttaaagttcatgttacacaattgggaagatgaagaatgcaaaaatatattgaaaagatgcaaagaggcaattccggcggacaaaggtaaggtgatcataatggatatagtgttggatgaaaacgcagataatgatgatttagtacaagccaagttgagcatggatcttgatatgatgagttcaggaggtcgagaaaggactaaagaagattggaaaaacctgctcgagatgtccgggtttacaagccatgaaatcattcccattctcgccatacagtccatcattgttgcatatccttga

SEQ ID NO: 574 - DNA, 1014 bp, Papaver bracteatum
atgatgagcattcgattcagattattgagatacttatctcatatgaatcttattgcaatgaatgcaattgaaggaaatgagacattttctttaacaggtatatctaaattactacttaagaatcaagaaagaagtttgaaagattgggttctcggtatcgacgatgagcattcgattaatgggtggcatgagttaagtgattattgtttatcggctactgatgcaccgactccatttgtgaaattgtatgggaaaactttatgggaatttgctgcagaagttcctgaagttaatgagctaattaataatgccatggcttgtgatactaggatggtgatgcctgcatttgtgcaaggttgtgacagtatattgaagagtgttaagaagttagttgatattggtggaggcaccggagctgcgatgagttatgttgttaaggcttatcctgagataaaatgtatggcttttgatttgcctcatgttgttgctgctgcaccggaggttccaggtgtggaaatggttggtggtgatatgtttgaattcattccccctgctgatgctcttttattgaagttcatgctgcataactggaaagacgccgaatgcataagtatggcttttgatttgcctcatgttgttgctgctgcaccggagattccaggtgtggaaatggttggtggagacatgtttgatttcattccctctgctgatgctcttttattgaagttcatgctgcataactggaaagacgccgaatgcataaaactgctaaagaggtgcaaggaaacaattcctgaagataatgggaaagttatcataatagaaatggttttggatcaagatgaagatgatgatgatttgacacaagctagattgagtcttgatctagatatgatgttgagttcaggagggaaagaaaggactaaagatgaatggagaattttacttgaagaggctggtttcaataagattgaattcattcctatttttgcaattcagtcggttattgtggca

SEQ ID NO: 575 - DNA, 1173 bp, Papaver bracteatum
atggctaccaatggcgaaattttcgatacctatggtcataatcatcaaacagccacagtcactaaaatcactgcttctgatgacagcagtaatgatgtctgttatctttcagaaacggctaacttagggaagttaatatgcattccaatggcattaagagctgcgatggagctaaatgtgttccaacttatctcaaagtttggaactgacgcaaaagtttcggcttctgaaattgcctctaaaatgccaaacacgacgagtaacccaacagcagctatctatttagatagagttcttcgactgctcggtgccagttctattctttccgtttctaccagaaaaaaattaatcaacggaggaggagaagatagagtagtacatgagaaggtgtacgggctaacgaattcgtcgtgctgtttggtccctcgagaagaagacggggtgtcattagtcgaagaattgctattcacatctgacaaggttgttgtggatagttttttcaaactgaaatgtgtggtggaagaaaaagacagtgtgccatttgaggttgctcatggtgctaagatctttgagtatgctgctacagaaccaagaatgaataaggtttttaacgatggaatggcagttttctctattgttgtttttgaagctgtttttagagtttacgatggatttcttgacatgaaagaattgttagatgttggtggtggtattggtacttcagttagtaaaattgttgctaaataccctttcattcgcggtgtcaacttcgacttgcctcatgttatttctgttgcccctcaatacccaggggtagagcatgttgcaggagacatgttcgaggaagttccaaagggtcaaaacatgttgctaaaatgggtactgcacgattggggtgacgaacgatgtgtgaagctgttaaagaattgttggaagtcattacctgcgggtggaaaagttttgataatcgagtttgttcttccgaatgaacttggtaataatgccgaatcattcaatgcgttgattcccgatttactcctgatggctctgaatccaggcggtaaagaacgaacaatttcggaatatgatgatttagccaaagcagctggatttataaaaactatacctatccctatctccaatggtcttcatgtcattgagtttcacaaatga

SEQ ID NO: 576 - DNA, 1167 bp, Papaver bracteatum
atgactatggaaattgatcatggtgaagaacatgatacatcagcatcatctactactaacctcggtgatgatgtatcttatctttctgataatgcaaatttaggtaagctcatatgcattccaatggcactaagagctgcgatggagctaaacgtgttccagctcatctcaaaattcgggcttgatgcaaaggtttcggcttctcaactagtctcaaaaatgccgaacgcacccaataatcctaatgcagcaatgtatttagataggattctccgtttacttggggcaagttccattctttcagtttctaatagcatggaaagtggtggtcactgtgttaatcagaataatggagaagctggagcagtagcaatggagagagtgtatggattaacgagggcatcgtattgtttagtgcctcgagaagaagacggagtttcgctagtaccactcttggtgttacaatctgataaggtcatagttgatagtttttttaaattgaaagagatggttatggagaaagatgttgtgccatttgatgctgctcatggtattagcatcttcgagtatgcttgcaaagagccaagattgaataaggcttttaatgagggaatgggagctttctctgctgttgtttttgaagctgtttttaagtactatgatgggttttctgggatgaaagaattgttagatgttggtggtgggatcggtacttccgttagtaagattgtcgcgaaataccattccattcgtggtatcaactttgacttgcctcatgttatttctgttgctcctcaatacccaggtgtggagcatgttcaaggagatatgttcgaacaagttccaaaggctcaaaacatgttgctaaaatggatacttcacgattatgacgatgaacattgtgtgaagttgttaaagaactgctggaactcgttacaagtgggtggaagagttatgataattgagtttgctgttcctaacaaacttgtcaatagtgcagaaacgttcaatccgttgaattctgatttaatgatgatggctgtgaatccaggcggtaaagaacgaacaatgtttgaatttaataatttggccagtgcatctgggtttgcgaaaactgtacatttcttgatctccgaatcacttcacctcattgagtttcataaatga

SEQ ID NO: 577 - DNA, 1122 bp, Papaver bracteatum
atgagttattcgatacccattcatgttaatgaactaaaccatcaagatttagaagaaaatgatgatcaactctgtattttagcatgtcaaattgcagcttgctcaggacttccgatggctttaaaagctgcattagatcttgatttactcgaaaccatagctaaagcgggtccaaatgcatacatctccccattagagatttcatccaagttaggtactcaaaatcccaatgcaccttccatgttagataggcttttgcgtttgttaacaagcttttctatcctcaaatgctcacaaatcactacccaagatggcaagattcaacgactgtatgggttagcacctgtttgcaagtattttactagggatccagaaaatggtgtctctgttgctcctttagctgtgatgaatacagacagggtcttcatagatagttggtatcactttaaagatgctgtaatggaaggtggaattcctttcaatagagctcatgggatgagtgcatttgaataccccgggctagatcttagattcaatcaagtttttaataaagctatgtcagatcacactaccttgactatgacaaaagtacttgaaaaatacaaaggatttgaaggtattaaagtgttggttgatgttggtggtggtgttggagtcacaactaaaatgattactgccaagtatcctcaacttaagggtatcaatttcgacttgcctcatgtattagcagatgcaacaacatatcccggagtggagaatgttggaggagacatgtttgtcagtgtcccaagaggggatgccattttcatgaagtggattcttcacgattggagtgatgagtattgcttgaaactcttaaaaaactgttatgaagctctaccagactgcggaaaagtgatcattattgaagcgaatcttcctgcagtcattgatgatagtgttacctcaaaacttttgtttgaacaagatatggtcatgttaactcagaaccctggaggtaaagaaaggacattttcagaatttgaagacctggcaaagcaatctggatttgctagctgtgagactctatgttctgtttactacagttacgttatggagttccataaaacagctaggatttag

SEQ ID NO: 578 - DNA, 1128 bp, Papaver bracteatum
atgggttcaggccatcacagcaaacacaaaggtgatcatcatgaagaagagcattccaaagataaaaaagaagaacaagcatgtatgtttgcattacaattggctagtgcatcagtaccagtgatggtattaagagctgcaattgaaatggatgttttggaaataatgaacagagctggtccaggttctgaacttagtgctgcatatattgcatcacagattctcaatgttaccaacccgaatgctagtattatgcttgatcgtatgttgagattattggctagttataagattcttacttgttctgacagaactcttgacgatggcacaactgagagagtctatggtcttgaacttgtttgcaagtttcttgtcaaggatgatgatggtgtttcaatggctcctttgcttttgatgaaccaagataagatcttattggagagctggttccatttgaaagacgcggttgtgaccggcggtatcccatttaacctggcatacggcatgaacgcattcgaatacccagcaacagatgcaaggttcaacacggtgttcaacaaaggaatgtcagatcacactgcaattttcatgaaaaagattttagaaacatacaaaggtttcgaaggtataaattccatcgttgatgttggtggaggcgtcggtgtcagtctagacatgattcttaccaagtacccatccatgaaaggtattaacttcgatttaccacacgtaatcaaagacgcgccagcttacgaatccgcagtcgaacatgttggaggagatatgtttgtgagtgttccaaaagggactgatgctgtattcatgaaatggattcttcatgactggagtgacgagttttgcacaaaagttttgaagaatattcatgatgctttacctgaacatggtaaattgatactagtggaatgcattattccaccaacatgtgaaccaactcttgaagctttaggtgtttaccatgttgataatatgatgatggcttacaaccctggtggcaaagaaaggactgagaaagagtttgatgctttggctaaagcaactggattttctggtgttaagcttatctgttctgcttttaacacttggattatggagtgccacaagaactaa

SEQ ID NO: 579 - protein, 353 aa, Papaver bracteatum
MGSQATETQVVSLEDQAQIWNIIYGFADSLVLRCAVQIGIPDIIKNNKGSITLAQLSSKLPIPDVNSGHLQRIIRYLVQLDILQQETCNGGAEMVYSLKPAGTLLLRDAKISMVPMLLGLTQKDFMVPWHFIKEVLGNGSATAFEIGMGKTMWQYLADNPEQSQLFDEGMAGDITLLSKTLTEDCSDIFQGLDSLVDVGGGNGAAIMAIYEAFPHIKCTLFDLPHVIASSHNHPKIEKIPGDMFKSVPSAQALLLKSILHDWTDEECVKILKNCKEAIPKETGKVIIVDIALEEESTHPLAKKRLVLDIDMLVNTGGRERTADDWENLLKSAGFRSHKISPIRAMQSVIEAFP

SEQ ID NO: 580 - protein, 346 aa, Papaver bracteatum
METVSKIDQQNQAKIWKQIYGFAESLVLKCAVQLEIAETLHNNVKPMSLSELASKLPVAQPVNEDRLFRIMRYLVHMELFKIDATTQKYSLAPPAKYLLRGWEKSMVDSILCINDKDFLAPWHHLGDGLTGNCDAFEKALGKSIWVYMSENPEKNQLFNAAMACDTRLVTSALANECKSIFSDGIRTLVDVGGGTGTAVKTISKAFPDIKCTIYDLPHVIADSPEIPNITKISGDMFKSIPSADAIFMKCILHDWNDEECIQILKRCKEALPKDGKVIIVDVVIDMDSTHPYAKIRLTLDLDMMLNTGGKERTKEEWKILFDAAGFASHKVTQISAVQSVIEAYPY

SEQ ID NO: 581 - protein, 349 aa, Papaver bracteatum
MEVVYKIDQENQAKIWKMIYGFSESLVLKCAVQLEIAETIHNHGKPMSLSELASKLPVQPVNSDRLFRIMRYLVHMKLFKIEVSSLNGGSAYSLAPPGKYLIRGWGKSMVASILAMNDNDLLAPWHHLNEGLTGNCNAFEKALGKSIWVYMSENPEKNQLFNEAMACDTELVNSALVNECKSVFCNGTKTLVDVGGGIGAAMMAISEAFPSIKCTIFDLPHVIAESPEMPNITKISGDMFESIPSADAIFMKNILHDWNDDKCIQILKRCKEALPRGGKVIIVDIVLDVADSVNPFSKIRLASDLDMMLNTGGRERTEKELKKLIDASGFASYKITQMSAVQSVIEVYP

SEQ ID NO: 582 - protein, 363 aa, Papaver bracteatum
LNSTSKEEIELIQAHTHIWKYVFSYANSMSLKCVVELGIPDIIHSHGKPMTLSSLVDALFLPSARIDPLNRLMRFMIHSGFFETRSLGENQEQQGYILTPTSRLLVKANPKTMSSVVLSMVDPIMVSSFQSLHTWFQGSESSPFVAAHGMSLWNLLEQNPESGKNFHDSMANDSCVLMSVILNEGKGVFNNLKSLVDVGGGTGTTAHAVVGAFPHLNCMVLDLPNVVADLQGTANVVFIGGDMFESIPHADAVLLKFILHDWSDKDCVRILKMCREAIPSTEEGGKVIIIDAVIEEDKKKKQEAKDDSIITETQLLFDIMMMAFVNGKERTEKEWKKLFIDSGFTDYKITRVQGFRSFIEVYP

SEQ ID NO: 583 - protein, 353 aa, Papaver bracteatum
MDAEEEITKGQAEIWEHMFAFADSMALKCAVELGIPDIINSHGHPVTVFEIINSLKTTTSSSSPNIDYLTRVMRLLVRKSIFTSHFHQETNQILYGLTPSSKWLLRDSKFNLSPTISFFLHPSILKPWQYLGNCTKENGLAFQKAHGCEIWDMAAADPHFNQVFNDGMGCTAKMIVSQMLTEYKDGFNCIGSLVDVGGGKGAMIAAIVEANPHITGINFDLPHVLATAQEHPGVTHVTGDMFVEIPEADAVIMKWIMHDWSDENCVKILKNCYKAISKTKNGKVIIVDCVLQPEGNGLFDETGVAFDLLMMVIPGGKERTEVEWNNLLKSAGFPRYNLIQIPTIHSIIEAFPE

SEQ ID NO: 584 - protein, 352 aa, Papaver bracteatum
MDTAEERLKGQAEIWEHMFAFVDSMALKCAVELGIPDIINSHGRPITMSEIIDYLKTNTSSLNVDYLTRVMRLLVHKRLFTSQLHQENNQIVYGLTRSSKWLLKDSKFNLSPLVLFETSPQPLKPWQYLGKCVQENGLPFESAHGCGIWDLALADPKFNGKLNGAMQCMTILIINEMLTEYKGGFNGIRSIVDVGGGTGTLLAEIVGANPHIQGINFDLPHVVTTCPDILGVKHLGGDMFVSIPEADAVIMKSLLHDWTDEDCTKILKNCYKAITNKKNGKVIIVEFVLRPEGNGLFDKTGLILDMVMLAHTSGGKERTEVEWKMLLSNAGFPRYNILQTPACPCIIEAFPE

SEQ ID NO: 585 - protein, 355 aa, Papaver bracteatum
MDIEEERLKGQAEIWEHMFAFANSMALKCAIELGMPDIINSYGRPVTMSEIINSLKKTTLSSSPNVDYLTRVMRLLVHKRIFASQFHQESNQILYDLTPSSKWLLRDSKSTLAPMILLHLHPLFLKPWQYVGKSVEESGFPFEKAHGCDAWDLALANPHFNQLFNDGMECSAKIAVNKMLANYKGGFNGIGVLVDVGGGTGSMIAGIVKANPHIRGVNFDLPHVVATAPEHPGITHVGGDMFADIPEGDAIIMKWIMHDWSDEDCIKILRNCYKAISKTKNGKVIIVDCVLQPDHGNGLFDEAGLLFDLLMMVNTSGGKERTEVEWNMLLNSAGFTRYNIIQIPTFPSIIEAFPE

SEQ ID NO: 586 - protein, 354 aa, Papaver bracteatum
MDTAEERLKGQAEIWEHMFAFVDSMALKCAVELGIPDIINSHGHPVTISEIIDSLKKSTSTSPNIDYLTRIMRLLVHKKLFTSQFHQESNQIVYDLTRSSKWLLKDSKFNLSPLVLWENNPILLKPWQYLGKCVQENSSPFERAHGCEIWDLALADPKFNNFLNGAMRCSTTTIINEMLLEYKDGFSGIAGSLVDVGGGTGSIIAEIVEANPHIQGINFDLPHVVATAPEFPGVKHVGGDMFVDIPEADAVIMKWTLHDWSDEDCTIILKNCYQAIRKKKNGKVIIVDCVLRPDGNDLFDKMGLIFDVLMMAHTTAGKERTEAEWKILLNNAGFPRYNVIRTPAFSCIIEAFPE

SEQ ID NO: 587 - protein, 353 aa, Papaver bracteatum
MDTAEERLKGQIEIWELTGAVIDSMALRCAVELGIPDIINSHGRPITISEIINSLKSTKASPNAEYLTRVMRLLVHNRVFTSQVHQESNQIVYNLTRSSKWLLKDSKFNLSPTVLFDTHPIIVKPWQYLGRCVQENGFPFERAHGREIWDLASADPKFNNLLNGAMGCTSTTIINEMLLGYKDGFSGIGSLVDVGGGTGTIIAEIVEANPHIIGTNFDLPHVVATAPDFPGIKHVGGDMFVNIPEADAVLMKWILHDWSDEDCTKILKNCYKAITKKKNGKVIIVECVLRPGGTGLFDKIGLIFDMGMLALTSGGKERTEDEWKMLLNNAGFPRYNIIQTPSCAYCIIVAFPE

SEQ ID NO: 588 - protein, 353 aa, Papaver bracteatum
MDAEEERLKGQAEILEHMFAFVDSMALKCVVELGIPDIINSHSRPVTMSEIIDNLKTNNLSSPNVDYLTRVMRFLVHKGLFSSQFHQESNQDVYNLTRSSKWLLKDSKFDLSPFVIVETNPILQKPWQYLGKCVQENGLPFERAYGCGIWDLALIDPKFNNNFNCAMQCMTMMMINEMLIEHKDRFNGIGLLVDVGGGTGTMIAEIVKANPHMQGMNFDLPHVVATAPDFPGVKHVGGDMFIDIPEADAVIMKLVLHDWTDEDCRKILKNCYNAITNKKDGKVIIVEYVLRPEESGLFDKTGLILDMVMMVHTSGGKERNEVEWKVLLNNAGFPRCNIFQSPAYICFIEAFPE

SEQ ID NO: 589 - protein, 339 aa, Papaver bracteatum
MEVVNKIDQENQAKIWKQIYGFAESLVLKCAVQLQIAETLHNNVKPMSLSDLASKLPVQPVNEDRLYRILRYLVHMKLFNKNATTQRYSLAPPAKYLLRGWEKSMVASILSVTDKDFTAPWKHLSDGLTGNCNAFEKALGKSIRVYMSENPEKNQLFNEGMACDTGLFTSAMVNECKNILSDGINTLALVGGGAGTAVKAISKAFPETKCTIHDLPQILSNINKTSRDLFKSVPSADAIFMKSILHEWNDEECIQILKRCKEAVPNGGKVIIADVVLDMDSTHPYSKSRLAMDLDMMLHTGGKERTEEDWKKLIDAAGFASCKITNLSALQSVIEAYPH

SEQ ID NO: 590 - protein, 354 aa, Papaver bracteatum
MEIKLEDQEQEMKNQGHVWNIICGSVDSSVLKCTVELGILDTIHHSSKPMTLSSLSSASPSLSTLKAENLYRLLRYLSHMNLIAIDSTEGNETFSLTGLSKLLLKNQERSLKDWVLGIDDEHSINGWHELSDYCLSATDAPTPFVKLYGKTLWEFAAEVPEVNELINNAMACDTRMVMPAFVQGCDSILKSVKKLVDIGGGTGAAMSYVVKAYPEIKCMAFDLPHVVAAAPEVPGVEMVGGDMFDIIPSADALLLKFMLHNWKDAECIKLLKRCKETIPEDNGKVIIIEMVLDQDEDDDVLTQARLSLDLDMMLSSGGKERTKDEWRILLEEAGFNKIEFIPIFAIQSVIVAYP

SEQ ID NO: 591 - protein, 373 aa, Papaver bracteatum
MATLSSKITGPERVLDEGIHFESQEQEMKYQAQIWNHMCGVVDTSVLKCAIELGIFDAIHNSSKPAITLTELSSVISSSTPSASSIEPRNLYRLMRYLSQMNLISTEKCSDEVTVSLTDTSKLLLRNQEKSLIDWVLGISSEPCVLVWHELSSSLSTPADGPPSFEKVHGKNCYELAGENPEWNELINNGMTSDTSLTMPAFIQGCDRILKGITSLIDVGGGTGASMAYVVKAFPHIKCGVFDLPHVVEAAPQCPGVEFIGGDVFKFLPNADALLLKYTLHNWEDPECVDLLKRCKEVIPADNGKVIIMDLVIDQDDNDTLMQARLSLDLDVLNHGGRERTKEDWRNLIEMSGFSRHEIIPIFAMPSVIVAYP

SEQ ID NO: 592 - protein, 358 aa, Papaver bracteatum
MDIKLEDEEQEIKYQGHVWNMICGSVNSSVLKCTIVLGLFDTIHNSSKPMTLSSLSSASPSLSPLKTEKLYRLLRYLSHMNLIAINSVQGSDDTFSLTDTSKLLLSNQERSLKDWVLGIDDPLAINGWHELSDYCLSPVDAPVPFVKMHGKTMWEFAAEIPEVNELFNNSMACDTKLVMPAFLQGCHSIFNKGTVKKMVDIGGGTGAAMSYVVKAFPDIKCMVFDLPHVVANAPEIQGVELVGGDMFEFIPPADALLLKFILHNWDDVGCIKLLKKCKETISADHGKVIIIEMVLEEDDHDNDALTQARLSLDLDMMVCSGGRERTKDEWTTLVEQAGFSKIEFFPIFAIQSVIVAYP

SEQ ID NO: 593 - protein, 357 aa, Papaver bracteatum
MEIQMEDEQLEMKYQSQIWNHVCGSVNTSVLKCSISLGIFDVIHDSGKSMLTLTELSNSLSSSNMIKTHNLYRLLRYLSHMNLIAISSIQGNDHFSLTDLSKLLLGNQEKSLKDWAIGIGDVNFVATWHEMSSSCSKLPGDLTAWETVHGKEGYELNVEDPEFSERFDKAMSSDTTLAMPAFIQGCDIIMSGISSLVDVGGGIGTAMTYVVKAFPHIKCTVFDVPHVIHTAADPAKCHGIEFIGGDLFSFIPPADAILLKFMLHNWEDEECKNILKRCKEAIPADKGKVIIMDIVLDENADNDDLVQAKLSMDLDMMSSGGRERTKEDWKNLLEMSGFTSHEIIPILAIQSIIVAYP

SEQ ID NO: 594 - protein, 338 aa, Papaver bracteatum
MMSIRFRLLRYLSHMNLIAMNAIEGNETFSLTGISKLLLKNQERSLKDWVLGIDDEHSINGWHELSDYCLSATDAPTPFVKLYGKTLWEFAAEVPEVNELINNAMACDTRMVMPAFVQGCDSILKSVKKLVDIGGGTGAAMSYVVKAYPEIKCMAFDLPHVVAAAPEVPGVEMVGGDMFEFIPPADALLLKFMLHNWKDAECISMAFDLPHVVAAAPEIPGVEMVGGDMFDFIPSADALLLKFMLHNWKDAECIKLLKRCKETIPEDNGKVIIIEMVLDQDEDDDDLTQARLSLDLDMMLSSGGKERTKDEWRILLEEAGFNKIEFIPIFAIQSVIVA

SEQ ID NO: 595 - protein, 390 aa, Papaver bracteatum
MATNGEIFDTYGHNHQTATVTKITASDDSSNDVCYLSETANLGKLICIPMALRAAMELNVFQLISKFGTDAKVSASEIASKMPNTTSNPTAAIYLDRVLRLLGASSILSVSTRKKLINGGGEDRVVHEKVYGLTNSSCCLVPREEDGVSLVEELLFTSDKVVVDSFFKLKCVVEEKDSVPFEVAHGAKIFEYAATEPRMNKVFNDGMAVFSIVVFEAVFRVYDGFLDMKELLDVGGGIGTSVSKIVAKYPFIRGVNFDLPHVISVAPQYPGVEHVAGDMFEEVPKGQNMLLKWVLHDWGDERCVKLLKNCWKSLPAGGKVLIIEFVLPNELGNNAESFNALIPDLLLMALNPGGKERTISEYDDLAKAAGFIKTIPIPISNGLHVIEFHK

SEQ ID NO: 596 - protein, 388 aa, Papaver bracteatum
MTMEIDHGEEHDTSASSTTNLGDDVSYLSDNANLGKLICIPMALRAAMELNVFQLISKFGLDAKVSASQLVSKMPNAPNNPNAAMYLDRILRLLGASSILSVSNSMESGGHCVNQNNGEAGAVAMERVYGLTRASYCLVPREEDGVSLVPLLVLQSDKVIVDSFFKLKEMVMEKDVVPFDAAHGISIFEYACKEPRLNKAFNEGMGAFSAVVFEAVFKYYDGFSGMKELLDVGGGIGTSVSKIVAKYHSIRGINFDLPHVISVAPQYPGVEHVQGDMFEQVPKAQNMLLKWILHDYDDEHCVKLLKNCWNSLQVGGRVMIIEFAVPNKLVNSAETFNPLNSDLMMMAVNPGGKERTMFEFNNLASASGFAKTVHFLISESLHLIEFHK

SEQ ID NO: 597 - protein, 373 aa, Papaver bracteatum
MSYSIPIHVNELNHQDLEENDDQLCILACQIAACSGLPMALKAALDLDLLETIAKAGPNAYISPLEISSKLGTQNPNAPSMLDRLLRLLTSFSILKCSQITTQDGKIQRLYGLAPVCKYFTRDPENGVSVAPLAVMNTDRVFIDSWYHFKDAVMEGGIPFNRAHGMSAFEYPGLDLRFNQVFNKAMSDHTTLTMTKVLEKYKGFEGIKVLVDVGGGVGVTTKMITAKYPQLKGINFDLPHVLADATTYPGVENVGGDMFVSVPRGDAIFMKWILHDWSDEYCLKLLKNCYEALPDCGKVIIIEANLPAVIDDSVTSKLLFEQDMVMLTQNPGGKERTFSEFEDLAKQSGFASCETLCSVYYSYVMEFHKTARI

SEQ ID NO: 598 - protein, 375 aa, Papaver bracteatum
MGSGHHSKHKGDHHEEEHSKDKKEEQACMFALQLASASVPVMVLRAAIEMDVLEIMNRAGPGSELSAAYIASQILNVTNPNASIMLDRMLRLLASYKILTCSDRTLDDGTTERVYGLELVCKFLVKDDDGVSMAPLLLMNQDKILLESWFHLKDAVVTGGIPFNLAYGMNAFEYPATDARFNTVFNKGMSDHTAIFMKKILETYKGFEGINSIVDVGGGVGVSLDMILTKYPSMKGINFDLPHVIKDAPAYESAVEHVGGDMFVSVPKGTDAVFMKWILHDWSDEFCTKVLKNIHDALPEHGKLILVECIIPPTCEPTLEALGVYHVDNMMMAYNPGGKERTEKEFDALAKATGFSGVKLICSAFNTWIMECHKN

SEQ ID NO: 599 - DNA, 35 bp, Artificial Sequence
  Primer
attagcggccgcaccatggcgtatttgatgatcaa

SEQ ID NO: 600 - DNA, 32 bp, Artificial Sequence
  Primer
cataactagtgcatctagtgtgcgtggggtga

SEQ ID NO: 601 - DNA, 39 bp, Artificial Sequence
  Primer
gactgagctcatgcatggacagaaaaatatatcagagag

SEQ ID NO: 602 - DNA, 42 bp, Artificial Sequence
  Primer
gactggtacctactaaaggaaacccttctctttggcacatcg

SEQ ID NO: 603 - DNA, 31 bp, Artificial Sequence
  Primer
tgcatctagagaaattgacgagacaatatgg

SEQ ID NO: 604 - DNA, 33 bp, Artificial Sequence
  Primer
tgcaggtacccattcaaaaacgaatatgtgtgc

SEQ ID NO: 605 - DNA, 23 bp, Artificial Sequence
  Primer
ttactcaaggaagcacgatgagc

SEQ ID NO: 606 - DNA, 24 bp, Artificial Sequence
  Primer
gaaccgtagtttaatgtcttcggg

SEQ ID NO: 607 - DNA, 27 bp, Artificial Sequence
  Primer
gcggccgcgccatggttattcataaag

SEQ ID NO: 608 - DNA, 32 bp, Artificial Sequence
  Reverse primer
catacctagtgcaacccatgaataagagccgc

SEQ ID NO: 609 - DNA, 42 bp, Artificial Sequence
  Primer
gactggtaccatatggcaacaatgtctagtgctgctgtagta

SEQ ID NO: 610 - DNA, 42 bp, Artificial Sequence
  Reverse primer
gactaagcttcactaaaacagttggaggatctctcttaggtg

The invention claimed is:
1. A method of making noscapine comprising:
(a) providing a noscapine pathway precursor selected from a canadine derivative and a papaveroxine derivative; wherein
the canadine derivative is selected from the group of canadine derivatives consisting of each of (S)—N-methylcanadine; 1-hydroxy-N-methylcanadine; 1,13-dihydroxy-N-methylcanadine, 1-hydroxy-13-O-acetyl-N-methylcanadine; and 1,8-dihydroxy-13-O-acetyl-N-methyl canadine; and
the papaveroxine derivative is papaveroxine;
(b) contacting the noscapine pathway precursor with the enzymes listed below (i) in vitro or (ii) in a microorganism heterologously provided with the noscapine pathway precursor under reaction conditions permitting the catalysis of the noscapine pathway precursor to form noscapine;
wherein
(i) when the canadine derivative is (S)—N-methylcanadine, contacting the (S)—N-methylcanadine with each of the enzymes (i) CYP82Y1; (ii) CYP82X2; (iii) AT1; (iv) CYP82X1; (v) OMT; (vi) CXE1; and (vii) NOS;
(ii) when the canadine derivative is 1-hydroxy-N-methylcanadine, contacting the 1-hydroxy-N-methylcanadine with each of the enzymes (i) CYP82X2; (ii) AT1; (iii) CYP82X1; (iv) OMT; (v) CXE1; and (vi) NOS;
(iii) when the canadine derivative is 1,13-dihydroxy-N-methylcanadine, contacting the 1,13-dihydroxy-N-methylcanadine with each of the enzymes (i) AT1; (ii) CYP82X1; (iii) OMT; (iv) CXE1; and (v) NOS;
(iv) when the canadine derivative is 1-hydroxy-13-O-acetyl-N-methylcanadine, contacting the 1-hydroxy-13-O-acetyl-N-methylcanadine with each of the enzymes (i) CYP82X1; (ii) OMT; (iii) CXE1; and (iv) NOS;
(v) when the canadine derivative is 1,8-dihydroxy-13-O-acetyl-N-methylcanadine, contacting the 1,8-dihydroxy-13-O-acetyl-N-methylcanadine with each of the enzymes (i) OMT; and (ii) CXE1; and (iii) NOS;
(vi) when the papaveroxine derivative is papaveroxine, contacting the papaveroxine solely with the enzyme NOS; and
wherein
NOS comprises the amino acid sequence of SEQ.ID NO: 14; or a sequence at least 90% identical thereto;
CYP82Y1 comprises the amino acid sequence of SEQ.ID NO: 2, or a sequence at least 90% identical thereto;
CYP82X2 comprises the amino acid sequence of SEQ.ID NO: 4, or a sequence at least 90% identical thereto;
AT1 comprises the amino acid sequence of SEQ.ID NO: 6 or a sequence at least 90% identical thereto;
CYP82X1 comprises the amino acid sequence of SEQ.ID NO: 8, or a sequence at least 90% identical thereto;
OMT comprises the amino acid sequence of SEQ.ID NO: 10, or a sequence at least 90% identical thereto; and
CXE1 comprises the amino acid sequence of SEQ.ID NO: 12, or a sequence at least 90% identical thereto.

2. A method for producing noscapine from a pathway precursor selected from a canadine derivative and a papaveroxine derivative; wherein
the canadine derivative is selected from the group of canadine derivatives consisting of (S)—N-methylcanadine; 1-hydroxy-N-methylcanadine; 1,13-dihydroxy-N-methylcanadine, 1-hydroxy-13-O-acetyl-N-methylcanadine; and 1,8-dihydroxy-13-O-acetyl-N-methylcanadine heterologously provided to a host cell; and
the papaveroxine derivative is papaveroxine heterologously provided to a host cell;
the method comprising:
(a) providing a chimeric nucleic acid sequence comprising in the 5' to 3' direction of transcription as operably linked components:
(i) one or more nucleic acid sequences encoding one or more of the polypeptides selected from the group of polypeptides listed below; and
(ii) one or more nucleic acid sequences capable of controlling expression in a host cell;
(b) introducing the chimeric nucleic acid sequence into the host cell, and growing the host cell to produce the polypeptide and noscapine;
wherein:
(i) when the canadine derivative is (S)—N-methylcanadine, the enzymes are each of (i) CYP82Y1; (ii) CYP82X2; (iii) AT1; (iv) CYP82X1; (v) OMT; (vi) CXE1; and (vii) NOS;
(ii) when the canadine derivative is 1-hydroxy-N-methylcanadine, the enzymes are each of (i) CYP82X2; (ii) AT1; (iii) CYP82X1; (iv) OMT; (v) CXE1; and (vi) NOS;
(iii) when the canadine derivative is 1,13-dihydroxy-N-methylcanadine, the enzymes are each of (i) AT1; (ii) CYP82X1; (iii) OMT; (iv) CXE1; and (v) NOS;
(iv) when the canadine derivative is 1-hydroxy-13-O-acetyl-N-methylcanadine, the enzymes are each of (i) CYP82X1; (ii) OMT; (iii) CXE1; and (iv) NOS;
(v) when the canadine derivative is 1,8-dihydroxy-13-O-acetyl-N-methylcanadine, the enzymes are each of (i) OMT; (ii) CXE1; and (iii) NOS;
(vi) when the papaveroxine derivative is papaveroxine, the enzyme is solely NOS; and
wherein
NOS comprises the amino acid sequence of SEQ.ID NO: 14, or a sequence at least 90% identical thereto;
CYP82Y1 comprises the amino acid sequence of SEQ.ID NO: 2, or a sequence at least 90% identical thereto;
CYP82X2 comprises the amino acid sequence of SEQ.ID NO: 4, or a sequence at least 90% identical thereto;
AT1 comprises the amino acid sequence of SEQ.ID NO: 6, or a sequence at least 90% identical thereto;
CYP82X1 comprises the amino acid sequence of SEQ.ID NO: 8, or a sequence at least 90% identical thereto;
OMT comprises the amino acid sequence of SEQ.ID NO: 10, or a sequence at least 90% identical thereto; and
CXE1 comprises the amino acid sequence of SEQ.ID NO: 12, or a sequence at least 90% identical thereto.

3. The method according to claim 2, wherein the method further includes step (c) comprising recovering noscapine.

4. The method according to claim 1 wherein:
CYP82Y1 comprises the amino acid sequence of SEQ.ID NO: 2, or a sequence at least 95% identical thereto;
CYP82X2 comprises the amino acid sequence of SEQ.ID NO: 4, or a sequence at least 95% identical thereto;
AT1 comprises the amino acid sequence of SEQ.ID NO: 6, or a sequence at least 95% identical thereto;
CYP82X1 comprises the amino acid sequence of SEQ.ID NO: 8, or a sequence at least 95% identical thereto;
OMT comprises the amino acid sequence of SEQ.ID NO: 10, or a sequence at least 95% identical thereto;
CXE1 comprises the amino acid sequence of SEQ.ID NO: 12, or a sequence at least 95% identical thereto; and
NOS comprises the amino acid sequence of SEQ.ID NO: 14, or a sequence at least 95% identical thereto.

5. The method according to claim 1 wherein:
CYP82Y1 comprises the amino acid sequence of SEQ.ID NO: 2;
CYP82X2 comprises the amino acid sequence of SEQ.ID NO: 4;
AT1 comprises the amino acid sequence of SEQ.ID NO: 6;
CYP82X1 comprises the amino acid sequence of SEQ.ID NO: 8;
OMT comprises the amino acid sequence of SEQ.ID NO: 10;
CXE1 comprises the amino acid sequence of SEQ.ID NO: 12; and
NOS comprises the amino acid sequence of SEQ.ID NO: 14.

6. The method according to claim 1, wherein the reaction conditions are in vitro reaction conditions.

7. The method according to claim 1, wherein the microorganism is a bacterial cell or a fungal cell.

8. The method according to claim 7, wherein the bacterial cell is an *E. coli* cell.

9. The method according to claim 7, wherein the fungal cell is a yeast cell.

10. The method according to claim 2 wherein:
CYP82Y1 comprises the amino acid sequence of SEQ.ID NO: 2, or a sequence at least 95% identical thereto;
CYP82X2 comprises the amino acid sequence of SEQ.ID NO: 4, or a sequence at least 95% identical thereto;
AT1 comprises the amino acid sequence of SEQ.ID NO: 6, or a sequence at least 95% identical thereto;
CYP82X1 comprises the amino acid sequence of SEQ.ID NO: 8, or a sequence at least 95% identical thereto;
OMT comprises the amino acid sequence of SEQ.ID NO: 10, or a sequence at least 95% identical thereto;
CXE1 comprises the amino acid sequence of SEQ.ID NO: 12, or a sequence at least 95% identical thereto; and
NOS comprises the amino acid sequence of SEQ.ID NO: 14, or a sequence at least 95% identical thereto.

11. The method according to claim 2 wherein:
CYP82Y1 comprises the amino acid sequence of SEQ.ID NO: 2;
CYP82X2 comprises the amino acid sequence of SEQ.ID NO: 4;
AT1 comprises the amino acid sequence of SEQ.ID NO: 6;
CYP82X1 comprises the amino acid sequence of SEQ.ID NO: 8;
OMT comprises the amino acid sequence of SEQ.ID NO: 10;
CXE1 comprises the amino acid sequence of SEQ.ID NO: 12; and
NOS comprises the amino acid sequence of SEQ.ID NO: 14.

12. The method according to claim 2 wherein the cell is a bacterial cell, a fungal cell, or a plant cell.

13. The method according to claim 11, wherein the bacterial cell is an *E. coli* cell.

14. The method according to claim 11 wherein the fungal cell is a yeast cell.

* * * * *